US011180807B2

(12) United States Patent
Hatchwell et al.

(10) Patent No.: US 11,180,807 B2
(45) Date of Patent: Nov. 23, 2021

(54) METHODS FOR DETECTING A GENETIC VARIATION IN ATTRACTIN-LIKE 1 (ATRNL1) GENE IN SUBJECT WITH PARKINSON'S DISEASE

(71) Applicants: The Research Foundation of State of University of New York, Albany, NY (US); Population Bio, Inc., New York, NY (US)

(72) Inventors: Eli Hatchwell, Winchester (GB); Peggy S. Eis, Fitchburg, WI (US)

(73) Assignees: Population Bio, Inc., New York, NY (US); The Research Foundation of State of University of New York, Albany, NY (US)

( * ) Notice: Subject to any disclaimer, the term of this patent is extended or adjusted under 35 U.S.C. 154(b) by 0 days.

(21) Appl. No.: 13/668,049

(22) Filed: Nov. 2, 2012

(65) Prior Publication Data
US 2014/0155271 A1    Jun. 5, 2014

Related U.S. Application Data

(60) Provisional application No. 61/556,043, filed on Nov. 4, 2011, provisional application No. 61/556,077, filed on Nov. 4, 2011, provisional application No. 61/743,920, filed on Sep. 14, 2012.

(51) Int. Cl.
| | | |
|---|---|---|
| C12Q 1/6883 | (2018.01) | |
| C12Q 1/68 | (2018.01) | |
| G01N 33/50 | (2006.01) | |
| C12Q 1/6809 | (2018.01) | |
| C12Q 1/686 | (2018.01) | |
| C12Q 1/6827 | (2018.01) | |
| C12Q 1/6813 | (2018.01) | |
| C12Q 1/6869 | (2018.01) | |
| G01N 33/68 | (2006.01) | |
| G01N 33/48 | (2006.01) | |

(52) U.S. Cl.
CPC .......... *C12Q 1/6883* (2013.01); *C12Q 1/686* (2013.01); *C12Q 1/6809* (2013.01); *C12Q 1/6813* (2013.01); *C12Q 1/6827* (2013.01); *C12Q 1/6869* (2013.01); *G01N 33/5023* (2013.01); *G01N 33/6896* (2013.01); *C12Q 2600/156* (2013.01); *C12Q 2600/158* (2013.01); *G01N 33/48* (2013.01); *G01N 33/5005* (2013.01); *G01N 33/5058* (2013.01)

(58) Field of Classification Search
CPC ........ C12Q 2600/158; C12Q 2600/112; C12Q 2600/178; C12Q 1/6883; C12Q 2600/156; C12Q 2600/106; C12Q 1/6874; C12Q 2600/136; C12Q 2600/172; G06F 19/20; G06Q 99/00; C12N 15/111; C12N 15/62; C12N 2310/141; C12N 2320/10; G01N 33/5023; G01N 2500/04; G01N 2800/2835; G01N 2800/38; G01N 33/6845
See application file for complete search history.

(56) References Cited

U.S. PATENT DOCUMENTS

| | | |
|---|---|---|
| 3,625,214 A | 12/1971 | Higuchi et al. |
| 4,683,195 A | 7/1987 | Mullis et al. |
| 4,789,734 A | 12/1988 | Pierschbacher |
| 4,897,268 A | 1/1990 | Tice et al. |
| 4,906,474 A | 3/1990 | Langer et al. |
| 4,925,673 A | 5/1990 | Steiner et al. |
| 4,992,445 A | 2/1991 | Lawter et al. |
| 5,001,139 A | 3/1991 | Lawter et al. |
| 5,023,252 A | 6/1991 | Hseih |
| 5,075,109 A | 12/1991 | Tice et al. |
| 5,143,854 A | 9/1992 | Pirrung et al. |
| 5,190,029 A | 3/1993 | Byron et al. |
| 5,223,409 A | 6/1993 | Ladner et al. |
| 5,272,071 A | 12/1993 | Chappel |
| 5,288,514 A | 2/1994 | Ellman |
| 5,376,359 A | 12/1994 | Johnson |
| 5,384,261 A | 1/1995 | Winkler et al. |
| 5,424,186 A | 6/1995 | Fodor et al. |
| 5,445,934 A | 8/1995 | Fodor et al. |
| 5,451,683 A | 9/1995 | Barrett et al. |
| 5,510,270 A | 4/1996 | Fodor et al. |
| 5,527,681 A | 6/1996 | Holmes et al. |
| 5,665,549 A | 9/1997 | Pinkel et al. |
| 5,700,637 A | 12/1997 | Southern |
| 5,744,305 A | 4/1998 | Fodor et al. |
| 5,776,434 A | 7/1998 | Purewal et al. |
| 5,811,128 A | 9/1998 | Tice et al. |
| 5,814,344 A | 9/1998 | Tice et al. |

(Continued)

FOREIGN PATENT DOCUMENTS

| | | |
|---|---|---|
| CN | 1733937 A | 2/2006 |
| CN | 101148684 A | 3/2008 |

(Continued)

OTHER PUBLICATIONS

Nalls et al.( Neurogenetics (2009) 10:183-190).*
Simon-Sanchez et al.( Nature genetics 41.12 (2009): 1308-1312) and supplemental information.*
Nalls et al.( Lancet. Feb. 19, 2011;377(9766):641-9).*
Hattersley et al. The Lancet. 2005. 366: 1315-1323.*
Hirschhorn et al. Genetics in Medicine. 2002. 4(2): 45-61.*
Hegele, Arteriorscler. Thromb. Vasc. Biol. 2002; 22:1058-1061.*
Mizuno et al. BMC Genetics, 2010; 11:27.*
Pankratz et al. PLOS One; 2011, 6:e20988. doi:10.1371/journal.pone.0020988.*

(Continued)

*Primary Examiner* — Chang-Yu Wang
(74) *Attorney, Agent, or Firm* — Wilson Sonsini Goodrich & Rosati

(57) ABSTRACT

This document provides methods and materials related to genetic variations of neurological disorders. For example, this document provides methods for using such genetic variations to assess susceptibility of developing Parkinson's disease.

18 Claims, 6 Drawing Sheets
Specification includes a Sequence Listing.

(56) References Cited

U.S. PATENT DOCUMENTS

| | | | |
|---|---|---|---|
| 5,820,883 A | 10/1998 | Tice et al. | |
| 5,837,832 A | 11/1998 | Chee et al. | |
| 5,853,763 A | 12/1998 | Tice et al. | |
| 5,858,659 A | 1/1999 | Sapolsky et al. | |
| 5,928,647 A | 7/1999 | Rock | |
| 5,942,252 A | 8/1999 | Tice et al. | |
| 5,945,334 A | 8/1999 | Besemer et al. | |
| 6,040,138 A | 3/2000 | Lockhart et al. | |
| 6,054,270 A | 4/2000 | Southern | |
| 6,146,834 A | 11/2000 | Schaad et al. | |
| 6,207,392 B1 | 3/2001 | Weiss et al. | |
| 6,210,878 B1 | 4/2001 | Pinkel et al. | |
| 6,251,607 B1 | 6/2001 | Tsen et al. | |
| 6,300,063 B1 | 10/2001 | Lipshutz et al. | |
| 6,423,499 B1 | 7/2002 | Song et al. | |
| 6,429,027 B1 | 8/2002 | Chee et al. | |
| 6,733,977 B2 | 5/2004 | Besemer et al. | |
| 6,858,394 B1 | 2/2005 | Chee et al. | |
| 6,858,412 B2 | 2/2005 | Willis et al. | |
| 6,892,141 B1 | 5/2005 | Nakae et al. | |
| 6,916,621 B2 | 7/2005 | Shah | |
| 6,951,761 B2 | 10/2005 | Star et al. | |
| 6,969,589 B2 | 11/2005 | Patil et al. | |
| 6,977,148 B2 | 12/2005 | Dean et al. | |
| 7,011,949 B2 | 3/2006 | Amorese et al. | |
| 7,014,997 B2 | 3/2006 | Knoll et al. | |
| 7,030,231 B1 | 4/2006 | Craik et al. | |
| 7,034,144 B2 | 4/2006 | Van Dongen et al. | |
| 7,364,858 B2 | 4/2008 | Barany et al. | |
| 7,424,368 B2 | 9/2008 | Huang et al. | |
| 7,702,468 B2 | 4/2010 | Chinitz et al. | |
| 7,957,913 B2 | 6/2011 | Chinitz et al. | |
| 7,998,744 B2 | 8/2011 | Stevenson et al. | |
| 8,367,417 B2 | 2/2013 | Stevenson et al. | |
| 8,655,599 B2 | 2/2014 | Chinitz et al. | |
| 8,862,410 B2 * | 10/2014 | Hatchwell | C12Q 1/6827 702/19 |
| 9,976,180 B2 * | 5/2018 | Hatchwell | C12Q 1/6883 |
| 10,059,997 B2 * | 8/2018 | Hatchwell | C12Q 1/6827 |
| 2002/0012921 A1 | 1/2002 | Vincent, Jr. | |
| 2002/0012930 A1 | 1/2002 | Rothberg et al. | |
| 2003/0023070 A1 | 1/2003 | Ni et al. | |
| 2003/0049663 A1 | 3/2003 | Wigler et al. | |
| 2003/0068629 A1 | 4/2003 | Rothberg et al. | |
| 2003/0082606 A1 | 5/2003 | Lebo et al. | |
| 2003/0100102 A1 | 5/2003 | Rothberg et al. | |
| 2003/0148344 A1 | 8/2003 | Rothberg et al. | |
| 2003/0207295 A1 | 11/2003 | Gunderson et al. | |
| 2003/0215821 A1 | 11/2003 | Gunderson et al. | |
| 2004/0018491 A1 | 1/2004 | Gunderson et al. | |
| 2004/0137473 A1 | 7/2004 | Wigler et al. | |
| 2004/0157243 A1 | 8/2004 | Huang et al. | |
| 2004/0197774 A1 | 10/2004 | Wigler et al. | |
| 2004/0248161 A1 | 12/2004 | Rothberg et al. | |
| 2005/0032095 A1 | 2/2005 | Wigler et al. | |
| 2005/0037393 A1 | 2/2005 | Gunderson et al. | |
| 2005/0037414 A1 | 2/2005 | Lee et al. | |
| 2005/0079510 A1 | 4/2005 | Berka et al. | |
| 2005/0100893 A1 | 5/2005 | Gunderson et al. | |
| 2005/0100932 A1 | 5/2005 | Lapidus et al. | |
| 2005/0112595 A1 | 5/2005 | Zhao et al. | |
| 2005/0124022 A1 | 6/2005 | Srinivasan et al. | |
| 2005/0196799 A1 | 9/2005 | Wigler et al. | |
| 2005/0233339 A1 | 10/2005 | Barrett et al. | |
| 2005/0266444 A1 | 12/2005 | Wigler et al. | |
| 2005/0282196 A1 | 12/2005 | Costa | |
| 2006/0012784 A1 | 1/2006 | Ulmer | |
| 2006/0012793 A1 | 1/2006 | Harris | |
| 2006/0024678 A1 | 2/2006 | Buzby | |
| 2006/0024711 A1 | 2/2006 | Lapidus et al. | |
| 2006/0063168 A1 | 3/2006 | Albertson et al. | |
| 2006/0078909 A1 | 4/2006 | Srinivasan et al. | |
| 2006/0134674 A1 | 6/2006 | Huang et al. | |
| 2007/0141577 A1 | 6/2007 | Moore | |
| 2007/0207141 A1 | 9/2007 | Lieberburg | |
| 2007/0207481 A1 | 9/2007 | Wigler et al. | |
| 2007/0259351 A1 * | 11/2007 | Chinitz et al. | 435/6 |
| 2008/0131887 A1 | 6/2008 | Stephan et al. | |
| 2009/0026082 A1 | 1/2009 | Rothberg et al. | |
| 2009/0098547 A1 | 4/2009 | Ghosh | |
| 2009/0127589 A1 | 5/2009 | Rothberg et al. | |
| 2009/0170712 A1 | 7/2009 | Beatty et al. | |
| 2009/0304653 A1 | 12/2009 | Messier | |
| 2010/0003685 A1 * | 1/2010 | Aasly et al. | 435/6 |
| 2010/0028931 A1 | 2/2010 | Eggan et al. | |
| 2010/0035252 A1 | 2/2010 | Rothberg et al. | |
| 2010/0120046 A1 * | 5/2010 | Brennan et al. | 435/6 |
| 2010/0137143 A1 | 6/2010 | Rothberg et al. | |
| 2010/0167286 A1 | 7/2010 | Reijo Pera et al. | |
| 2010/0188073 A1 | 7/2010 | Rothberg et al. | |
| 2010/0197507 A1 | 8/2010 | Rothberg et al. | |
| 2010/0227768 A1 | 9/2010 | Wigler et al. | |
| 2010/0248236 A1 * | 9/2010 | Chinitz et al. | 435/6 |
| 2011/0021366 A1 | 1/2011 | Chinitz et al. | |
| 2011/0111014 A1 | 5/2011 | Langston | |
| 2011/0111419 A1 | 5/2011 | Stefansson et al. | |
| 2011/0130337 A1 * | 6/2011 | Eriksson et al. | 514/17.7 |
| 2011/0264376 A1 | 10/2011 | Chinitz et al. | |
| 2011/0311512 A1 | 12/2011 | Hakonarson et al. | |
| 2012/0046877 A1 | 2/2012 | Hyland et al. | |
| 2012/0059594 A1 | 3/2012 | Hatchwell et al. | |
| 2012/0100995 A1 | 4/2012 | Scherer et al. | |
| 2013/0247249 A1 | 9/2013 | Singh et al. | |
| 2013/0305410 A1 | 11/2013 | Bent et al. | |
| 2013/0316911 A1 | 11/2013 | Scherer | |
| 2014/0088882 A1 | 3/2014 | Chinitz et al. | |
| 2014/0161721 A1 | 6/2014 | Hatchwell et al. | |
| 2014/0162894 A1 | 6/2014 | Hatchwell et al. | |
| 2014/0162933 A1 * | 6/2014 | Hatchwell | C12Q 1/6883 514/1.1 |
| 2014/0208449 A1 | 7/2014 | Malek | |
| 2015/0051086 A1 | 2/2015 | Hatchwell et al. | |
| 2016/0019336 A1 | 1/2016 | Chinitz et al. | |
| 2017/0107563 A1 | 4/2017 | Samusik et al. | |

FOREIGN PATENT DOCUMENTS

| | | |
|---|---|---|
| CN | 101403008 A | 4/2009 |
| CN | 103436606 A | 12/2013 |
| EP | 0373203 B1 | 8/1994 |
| EP | 0619321 A1 | 10/1994 |
| EP | 2471916 A1 | 7/2012 |
| KR | 2009-0080105 A | 7/2009 |
| KR | 2011-0114664 A | 10/2011 |
| WO | WO 90/02809 A1 | 3/1990 |
| WO | WO 91/06667 A1 | 5/1991 |
| WO | WO 91/17271 A1 | 11/1991 |
| WO | WO 92/01047 A1 | 1/1992 |
| WO | WO 92/09690 A2 | 6/1992 |
| WO | WO 92/10092 A1 | 6/1992 |
| WO | WO 92/15679 A1 | 9/1992 |
| WO | WO 92/18619 A1 | 10/1992 |
| WO | WO 92/20791 A1 | 11/1992 |
| WO | WO 92/09690 A3 | 12/1992 |
| WO | WO 93/01288 A1 | 1/1993 |
| WO | WO 93/22684 A1 | 11/1993 |
| WO | WO 95/11995 A1 | 5/1995 |
| WO | WO 98/20019 A1 | 5/1998 |
| WO | WO 02/099129 A2 | 12/2002 |
| WO | WO 03/048318 A2 | 6/2003 |
| WO | WO 2004/018633 A2 | 3/2004 |
| WO | WO 2004/044225 A2 | 5/2004 |
| WO | WO 2004/075010 A2 | 9/2004 |
| WO | WO 2005/042763 A2 | 5/2005 |
| WO | WO 2005/068664 A2 | 7/2005 |
| WO | WO 2005/108997 A1 | 11/2005 |
| WO | WO 2004/044225 A3 | 4/2006 |
| WO | WO 2006/050475 A2 | 5/2006 |
| WO | WO-2006091254 A1 | 8/2006 |
| WO | WO-2006116873 A1 | 11/2006 |
| WO | WO 2007/070640 A2 | 6/2007 |
| WO | WO 2007/070640 A3 | 8/2007 |
| WO | WO 2007/129000 A2 | 11/2007 |
| WO | WO 2007/131135 A2 | 11/2007 |

(56) References Cited

FOREIGN PATENT DOCUMENTS

| WO | WO 2008/016374 A2 | 2/2008 |
|---|---|---|
| WO | WO 2007/129000 A3 | 3/2008 |
| WO | WO 2007/131135 A3 | 11/2008 |
| WO | WO-2009038684 A1 | 3/2009 |
| WO | WO 2009/043178 A1 | 4/2009 |
| WO | WO 2009/073764 A1 | 6/2009 |
| WO | WO 2010/036353 A2 | 4/2010 |
| WO | WO 2010/056897 A1 | 5/2010 |
| WO | WO-2010124101 A2 | 10/2010 |
| WO | WO 2011/012672 A1 | 2/2011 |
| WO | WO 2011/035012 A2 | 3/2011 |
| WO | WO-2011024822 A1 | 3/2011 |
| WO | WO 2011/112961 A1 | 9/2011 |
| WO | WO 2012/023519 A2 | 3/2012 |
| WO | WO-2012027491 A1 | 3/2012 |
| WO | WO 2012/047234 A1 | 4/2012 |
| WO | WO-2012064466 A2 | 5/2012 |
| WO | WO2012/113948 * | 8/2012 |
| WO | WO-2013059739 A1 | 4/2013 |
| WO | WO 2013/071119 A2 | 5/2013 |
| WO | WO-2013067451 A2 | 5/2013 |
| WO | WO 2014/043519 A1 | 3/2014 |
| WO | WO-2015131078 A1 | 9/2015 |

OTHER PUBLICATIONS

Toft et al. Genome Med. 2010; 2:62.*
The factsheet of ATRNL1 from the OMIM website retrived from http://omim.org/entry/612869 on Dec. 21, 2018.*
Stark et al. Eur. J. Med. Genet. 2010; 53:337-339.*
International search report and written opinion dated Apr. 22, 2013 for PCT/US2012/063451.
NCBI GenBank accession No. NM_207303.1. Apr. 20, 2004.
Stark, et al. De novo 325 kb microdeletion in chromosome band 10q25.3 including ATRNL1 in a boy with cognitive impairment, autism and dysmorphic features. Eur J Med Genet. Sep.-Oct. 2010;53(5):337-9. doi: 10.1016/j.ejmg.2010.07.009. Epub Jul. 27, 2010.
Walker, et al. Genetic analysis of attractin homologs. Genesis. 2007; 45(12):744-756.
Office action dated Nov. 18, 2013 for U.S. Appl. No. 13/196,882.
U.S. Appl. No. 14/090,932, filed Nov. 26, 2013, Chinitz et al.
Office action dated Apr. 3, 2013 for U.S. Appl. No. 13/095,722.
Bult, et al. The Mouse genome Database (MGD): mouse biology and model systems. Nucleic Acids Research. 2008; 36 Database Issue: D724-D728. doi:10.1093/nar/gkm961.
Office action dated Jul. 17, 2013 for U.S. Appl. No. 12/449,566.
U.S. Appl. No. 14/026,642, filed Sep. 13, 2013, Hatchwell et al.
Agami, R. RNAi and related mechanisms and their potential use for therapy. Curr Opin Chem Biol. Dec. 2002;6(6):829-34.
Aitman, et al. Copy number polymorphism in Fcgr3 predisposes to glomerulonephritis in rats and humans. Nature. Feb. 16, 2006;439(7078):851-5.
Albertson, et al. Profiling breast cancer by array CGH. Breast Cancer Res Treat. Apr. 2003;78(3):289-98.
Altschul, et al. Gapped BLAST and PSI-BLAST: a new generation of protein database search programs. Nucleic Acids Res. Sep. 1, 1997;25(17):3389-402.
Amarzguioui, et al. Approaches for chemically synthesized siRNA and vector-mediated RNAi. FEBS Lett. Oct. 31, 2005;579(26):5974-81. Epub Sep. 20, 2005.
Ansel et al., Pharmaceutical Dosage Forms and Drug Delivery Systems (Lippencott Williams & Wilkins, Baltimore Md. (1999).
Ausubel (Ed.), Current Protocols in Molecular Biology (2007 John Wiley & Sons, NY).
Bailey, et al. Analysis of Segmental Duplications and Genome Assembly in the Mouse. Genome Res. 2004; 14:789-801.
Bakkaloglu, et al. Molecular cytogenetic analysis and resequencing of contactin associated protein-like 2 in autism spectrum disorders. Am J Hum Genet. Jan. 2008;82(1):165-73.

Bedell, et al. In vivo genome editing using a high-efficiency TALEN system. Nature. Sep. 23, 2012. doi: 10.1038/nature11537. [Epub ahead of print].
Bennett, C. Efficiency of antisense oligonucleotide drug discovery. Antisense Nucleic Acid Drug Dev. Jun. 2002;12(3):215-24.
Berkel, et al. Mutations in the SHANK2 synaptic scaffolding gene in autism spectrum disorder and mental retardation. Nat Genet. Jun. 2010;42(6):489-91. Epub May 16, 2010.
Bernstein, et al. Role for a bidentate ribonuclease in the initiation step of RNA interference. Nature. Jan. 18, 2001;409(6818):363-6.
Bier, et al. DNA microarrays. Adv Biochem Eng Biotechnol. 2008;109:433-53.
Biomarkers Definitions Working Group. Biomarkers and surrogate endpoints: preferred definitions and conceptual framework. Clin Pharmacol Ther. Mar. 2001;69(3):89-95.
Bochukova, et al. Large, rare chromosomal deletions associated with severe early-onset obesity. Nature. Feb. 4, 2010;463(7281):666-70. Epub Dec. 6, 2009.
Bodmer, et al. Common and rare variants in multifactorial susceptibility to common diseases. Nat Genet. Jun. 2008;40(6):695-701.
Bosher, et al. RNA interference: genetic wand and genetic watchdog. Nat Cell Biol. Feb. 2000;2(2):E31-6.
Brummelkamp, et al. A system for stable expression of short interfering RNAs in mammalian cells. Science. Apr. 19, 2002;296(5567):550-3. Epub Mar. 21, 2002.
Calvo, et al. High-throughput, pooled sequencing identifies mutations in NUBPL and FOXRED1 in human complex I deficiency. Nat Genet. Oct. 2010;42(10):851-8. Epub Sep. 5, 2010.
Chavanpatil, et al. Novel sustained release, swellable and bioadhesive gastroretentive drug delivery system for ofloxacin. Int J Pharm. Jun. 19, 2006;316(1-2):86-92. Epub Mar. 29, 2006.
Chen, et al. The evolution of gene regulation by transcription factors and microRNAs. Nat Rev Genet. Feb. 2007;8(2):93-103.
Chen, H. Clinical development of antisense oligonucleotides as anti-cancer therapeutics. Methods Mol Med. 2003;75:621-36.
Chi, et al. Genomewide view of gene silencing by small interfering RNAs. Proc Natl Acad Sci U S A. May 27, 2003;100(11):6343-6. Epub May 2, 2003.
Conrad, et al. Origins and functional impact of copy number variation in the human genome. Nature. Apr. 1, 2010;464(7289):704-12. Epub Oct. 7, 2009.
Cronin, et al. Analysis of genome-wide copy number variation in Irish and Dutch ALS populations. Hum Mol Genet. Nov. 1, 2008; 17(21):3392-8. Epub Aug. 7, 2008.
Dias, et al. Antisense oligonucleotides: basic concepts and mechanisms. Mol Cancer Ther. Mar. 2002;1(5):347-55.
Dibbens, et al. Familial and sporadic 15q13.3 microdeletions in Idiopathic Generalized Epilepsy: Precedent for Disorders with Complex Inheritance. Hum Mol Genet. Jul. 10, 2009. [Epub ahead of print].
Elbashir, et al. RNA interference is mediated by 21- and 22-nucleotide RNAs. Genes Dev. Jan. 15, 2001; 15(2):188-200.
Estivill, et al. Copy number variants and common disorders: filling the gaps and exploring complexity in genome-wide association studies. PLoS Genet. Oct. 2007;3(10):1787-99.
Fan, et al. Illumina universal bead arrays. Methods Enzymol. 2006;410:57-73.
Fernandez, et al. Disruption of contactin 4 (CNTN4) results in developmental delay and other features of 3p deletion syndrome. Addendum. Am J Hum Genet. Jun. 2008;82(6):1385.
Fernandez, et al. Disruption of contactin 4 (CNTN4) results in developmental delay and other features of 3p deletion syndrome. Am J Hum Genet. Jun. 2004;74(6):1286-93.
Fire, et al. Potent and specific genetic interference by double-stranded RNA in Caenorhabditis elegans. Nature. Feb. 19, 1998;391(6669):806-11.
Freeman, et al. Copy number variation: new insights in genome diversity. Genome Res. Aug. 2006;16(8):949-61. Epub Jun. 29, 2006.
Galfre. et al. Antibodies to major histocompatibility antigens produced by hybrid cell lines. Nature. 1977;266:550-52.

(56) References Cited

OTHER PUBLICATIONS

Gilling, et al. Breakpoint cloning and haplotype analysis indicate a single origin of the common Inv(10)(p11.2q21.2) mutation among northern Europeans. Am. J. Hum. Genet. 2006; 78(5):878-83.
Glessner, et al. Autism genome-wide copy number variation reveals ubiquitin and neuronal genes. Nature. May 28, 2009;459(7246):569-73. Epub Apr. 28, 2009.
Goldstein. Common genetic variation and human traits. N Engl J Med. Apr. 23, 2009;360(17):1696-8. Epub Apr. 15, 2009.
Gribble, et al. The complex nature of constitutional de novo apparently balanced translocations in patients presenting with abnormal phenotypes. J. Med. Genet. 2005; 42:8-16.
Griffiths, et al. Human anti-self antibodies with high specificity from phage display libraries. EMBO J. Feb. 1993;12(2):725-34.
Grskovic, et al. Induced pluripotent stem cells—opportunities for disease modelling and drug discovery. Nat Rev Drug Discov. Nov. 11, 2011; 10(12):915-29. doi: 10.1038/nrd3577.
Harada, et al. Subtelomere specific microarray based comparative genomic hybridisation: a rapid detection system for cryptic rearrangements in idiopathic mental retardation. J. Med. Genet. 2004; 41:130-136.
Hatchwell, et al. High rate of submicroscopic human genomic polymorphism detected by array CGH. Proceedings of XIX International Genetics Congress. Melbourne, Australia. Abstracts and Posters. 2003; 1.E.0092. pp. 168 and 319.
Hay, et al. Bacteriophage cloning and *Escherichia coli* expression of a human IgM Fab. Hum Antibodies Hybridomas. Apr. 1992;3(2):81-5.
Helbig, et al. 15q13.3 microdeletions increase risk of idiopathic generalized epilepsy. Nat Genet. Feb. 2009;41(2): 160-2. Epub Jan. 11, 2009.
Hicks et al., "Novel patterns of genome rearrangement and their association with survival in breast cancer," Genome Res 16:1465-1479, 2006.
Hoffman, et al. Pharmacokinetic and pharmacodynamic aspects of gastroretentive dosage forms. Int J Pharm. Jun. 11, 2004;277(1-2):141-53.
Hoheisel, J. Microarray technology: beyond transcript profiling and genotype analysis. Nat Rev Genet. Mar. 2006;7(3):200-10.
Huang, et al. Whole genome DNA copy number changes identified by high density oligonucleotide arrays. Hum Genomics. May 2004;1(4):287-99.
Hunter, C. Genetics: a touch of elegance with RNAi. Curr Biol. Jun. 17, 1999;9(12):R440-2.
Huse, et al. Generation of a large combinatorial library of the immunoglobulin repertoire in phage lambda. Science. Dec. 8, 1989;246(4935):1275-81.
Hutvagner, et al. A microRNA in a multiple-turnover RNAi enzyme complex. Science. Sep. 20, 2002;297(5589):2056-60. Epub Aug. 1, 2002.
Iafrate, et al. Detection of large-scale variation in the human genome. Nature Genet. 2004;36:949-51.
International Search Report dated Sep. 11, 2008 for PCT Application No. US2007/68183.
Itsara, et al. Population analysis of large copy number variants and hotspots of human genetic disease. Am J Hum Genet. Feb. 2009;84(2):148-61. Epub Jan. 22, 2009.
Jorde, et al. Population genomics: a bridge from evolutionary history to genetic medicine. Hum. Mol. Genet. 2001; 10(20):2199-2207.
Kallioniemi, et al. Comparative genomic hybridization for molecular cytogenetic analysis of solid tumors. Science. Oct. 30, 1992;258(5083):818-21.
Karlin, et al. Applications and statistics for multiple high-scoring segments in molecular sequences. Proc Natl Acad Sci U S A. Jun. 15, 1993;90(12):5873-7.
Ketting, et al. Dicer functions in RNA interference and in synthesis of small RNA involved in developmental timing in C. elegans. Genes Dev. Oct. 15, 2001;15(20):2654-9.

Kim, et al. Strategies for silencing human disease using RNA interference. Nat Rev Genet. Mar. 2007;8(3):173-84.
Kim, et al. Synthetic dsRNA Dicer substrates enhance RNAi potency and efficacy. Nat Biotechnol. Feb. 2005;23(2):222-6. Epub Dec. 26, 2004.
Kimchi-Sarfaty, et al. A "silent" polymorphism in the MDR1 gene changes substrate specificity. Science. Jan. 26, 2007;315(5811):525-8. Epub Dec. 21, 2006.
Klausner, et al. Novel gastroretentive dosage forms: evaluation of gastroretentivity and its effect on levodopa absorption in humans. Pharm Res. Sep. 2003;20(9):1466-73.
Klein, et al. Comparative genomic hybridization, loss of heterozygosity, and DNA sequence analysis of single cells. Proc Natl Acad Sci U S A. Apr. 13, 1999;96(8):4494-9.
Kohler, et al. Continuous cultures of fused cells secreting antibody of predefined specificity. Nature. Aug. 7, 1975;256(5517):495-7.
Kozbor, et al. The production of monoclonal antibodies from human lymphocytes. Immunol. Today. 1983; 4(3): 72-79.
Kraus, et al. Detection and isolation of novel protein-tyrosine kinase genes employing reduced stringency hybridization. Methods Enzymol. 1991;200:546-56.
Kumar, et al. A de novo 1p34.2 microdeletion identifies the synaptic vesicle gene RIMS3 as a novel candidate for autism. J Med Genet. Jun. 21, 2009. [Epub ahead of print].
Kumar, et al. Recurrent 16p11.2 microdeletions in autism. Hum Mol Genet. Feb. 15, 2008;17(4):628-38. Epub Dec. 21, 2007.
Kurreck, J. Antisense technologies. Improvement through novel chemical modifications. Eur J Biochem. Apr. 2003;270(8):1628-44.
Kutyavin, et al. A novel endonuclease IV post-PCR genotyping system. Nucleic Acids Res. 2006;34(19):e128. Epub Sep. 29, 2006.
Latchman, et al. Viral vectors for gene therapy in Parkinson's disease. Rev Neurosci. 2001;12(1):69-78.
Lavery, et al. Antisense and RNAi: powerful tools in drug target discovery and validation. Curr Opin Drug Discov Devel. Jul. 2003;6(4):561-9.
Lerner, E. How to make a hybridoma. Yale J Biol Med. Sep.-Oct. 1981 54(5):387-402.
Manolio, et al. Finding the missing heritability of complex diseases. Nature. Oct. 8, 2009;461(7265):747-53.
Margulies, et al. Genome sequencing in microfabricated high-density picolitre reactors. Nature. Sep. 15, 2005;437(7057):376-80. Epub Jul. 31, 2005.
Marques, et al. A structural basis for discriminating between self and nonself double-stranded RNAs in mammalian cells. Nat Biotechnol. May 2006;24(5):559-65. Epub Apr. 30, 2006.
Martinez, et al. Single-stranded antisense siRNAs guide target RNA cleavage in RNAi. Cell. Sep. 6, 2002;110(5):563-74.
Mast, et al. Invader assay for single-nucleotide polymorphism genotyping and gene copy number evaluation. Methods Mol Biol. 2006;335:173-86. Abstract only.
McCarroll, et al. Copy-number variation and association studies of human disease. Nat Genet. Jul. 2007;39(7 Suppl):S37-42.
McCarthy, et al. Microduplications of 16p11.2 are associated with schizophrenia. Nat Genet. Nov. 2009;41(11):1223-7. Epub Oct. 25, 2009.
McManus, et al. Gene silencing in mammals by small interfering RNAs. Nat Rev Genet. Oct. 2002;3(10):737-47.
Mockler, et al. Applications of DNA tiling arrays for whole-genome analysis. Genomics. Jan. 2005;85(1):1-15.
Nord, et al. Accurate and exact CNV identification from targeted high-throughput sequence data. BMC Genomics. Apr. 12, 2011;12:184.
Nykanen, et al. ATP requirements and small interfering RNA structure in the RNA interference pathway. Cell. Nov. 2, 2001;107(3):309-21.
Office action dated Jan. 6, 2011 for U.S. Appl. No. 12/707,561.
Office action dated Sep. 13, 2012 for Chinese Application No. 200780015873.8.
Office action dated Dec. 16, 2008 for U.S. Appl. No. 11/421,348.
Office action dated Feb. 9, 2011 for UK Application No. GB0822081.6.
Office action dated Jun. 14, 2010 for UK Application No. GB0822081.6.
Office action dated Jun. 2, 2009 for U.S. Appl. No. 11/421,348.

(56) References Cited

OTHER PUBLICATIONS

Ozelius, et al. LRRK2 G2019S as a cause of Parkinson's disease in Ashkenazi Jews. N Engl J Med. Jan. 26, 2006;354(4):424-5.
Pang, et al. Towards a comprehensive structural variation map of an individual human genome. Genome Biol. 2010;11(5):R52. Epub May 19, 2010.
Peltz, et al. Targeting post-transcriptional control for drug discovery. RNA Biol. Jul.-Aug. 2009;6(3):329-34. Epub Jul. 7, 2009.
Perkel, J. SNP genotyping: six technologies that keyed a revolution. Nature Methods. 2008; 5:447-453.
Pinkel, et al. Comparative genomic hybridization. Annu. Rev. Genomics Hum. Genet. 2005;6:331-54.
Pinkel, et al. High resolution analysis of DNA copy number variation using comparative genomic hybridization to microarrays. Nat Genet. Oct. 1998;20(2):207-11.
Plasterk, et al. The silence of the genes. Curr Opin Genet Dev. Oct. 2000;10(5):562-7.
Pollack, et al. Microarray analysis reveals a major direct role of DNA copy number alteration in the transcriptional program of human breast tumors. Proc. Natl. Acad. Sci. 2002; 99(20):12963-68.
Provost, et al. Ribonuclease activity and RNA binding of recombinant human Dicer. EMBO J. Nov. 1, 2002;21(21):5864-74.
Ramsey, et al. A CFTR potentiator in patients with cystic fibrosis and the G551D mutation. N Engl J Med. Nov. 3, 2011;365(18):1663-72.
Raqoussis, et al. Affymetrix GeneChip system: moving from research to the clinic. Expert Rev Mol Diagn. Mar. 2006;6(2):145-52.
Redon, et al. Global variation in copy number in the human genome. Nature. Nov. 23, 2006;444(7118):444-54.
Rodriguez-Revenga, et al. Structural variation in the human genome: the impact of copy number variants on clinical diagnosis. Genet Med. Sep. 2007;9(9):600-6.
Roohi, et al. Disruption of contactin 4 in three subjects with autism spectrum disorder. J Med Genet. Mar. 2009;46(3):176-82.
Saha, et al. Technical challenges in using human induced pluripotent stem cells to model disease. Cell Stem Cell. Dec. 4, 2009;5(6):584-95.
Schapira, et al. Mitochondrial complex I deficiency in Parkinson's disease. Lancet. Jun. 3, 1989;1(8649):1269.
Schapira. Causes of neuronal death in Parkinson's disease. Adv Neurol. 2001;86:155-62.
Schapira. Mitochondrial complex I deficiency in Parkinson's disease. Adv Neurol. 1993;60:288-91.
Schule, et al. Can cellular models revolutionize drug discovery in Parkinson's disease? Biochim Biophys Acta. Nov. 2009;1792(11):1043-51. Epub Sep. 3, 2009.
Schwarz, et al. Asymmetry in the assembly of the RNAi enzyme complex. Cell. Oct. 17, 2003;115(2):199-208.
Sebat, et al. Large-scale copy number polymorphism in the human genome. Science. 2004; 305(5683):525-8.
Sebat, et al. Strong association of de novo copy number mutations with autism. Science. Apr. 20, 2007;316(5823):445-9.
Sharp, P. RNA interference—2001. Genes Dev. Mar. 1, 2001;15(5):485-90.
Shi, Y. Mammalian RNAi for the masses. Trends Genet. Jan. 2003;19(1):9-12.
Shuey, et al. RNAi: gene-silencing in therapeutic intervention. Drug Discov Today. Oct. 15, 2002;7(20):1040-6.
Siolas, et al. Synthetic shRNAs as potent RNAi triggers. Nat Biotechnol. Feb. 2005;23(2):227-31. Epub Dec. 26, 2004.
Smith, et al. A high-density admixture map for disease gene discovery in african americans. Am J Hum Genet. May 2004;74(5):1001-13. Epub Apr. 14, 2004.
Snijders, et al. Assembly of microarrays for genome-wide measurement of DNA copy number Nature Genet. 2001; 29:263-264.
Snijders, et al. BAC microarray-based comparative genomic hybridization. Methods Mol Biol. 2004;256:39-56.
Snijders, et al. Mapping segmental and sequence variations among laboratory mice using BAC array CGH. Genome Res. Feb. 2005;15(2):302-11.

Soni, et al. Progress toward ultrafast DNA sequencing using solid-state nanopores. Clin Chem. Nov. 2007;53(11):1996-2001. Epub Sep. 21, 2007.
Stefansson, et al. Large recurrent microdeletions associated with schizophrenia. Nature. Sep. 11, 2008;455(7210):232-6.
Stephens, et al. Antisense oligonucleotide therapy in cancer. Curr Opin Mol Ther. Apr. 2003;5(2):118-22.
Streubel, et al. Gastroretentive drug delivery systems. Expert Opin Drug Deliv. Mar. 2006;3(2):217-33.
Summary of NRSP-8 Accomplishments: 2003-2008. Available at http://www.lgu.umd.edu/lgu_v2/pages/attachs/9956_Attach1%20%202003-08%20ACCOMPLISHMENTS.doc. Published on Feb. 9, 2008. (6 pages).
Tabara, et al. The dsRNA binding protein RDE-4 interacts with RDE-1, DCR-1, and a DExH-box helicase to direct RNAi in C. elegans. Cell. Jun. 28, 2002; 109(7):861-71.
Teo, et al. Statistical challenges associated with detecting copy number variations with next-generation sequencing. Bioinformatics. Aug. 31, 2012.
The International Schizophrenia Consortium. Rare chromosomal deletions and duplications increase risk of schizophrenia. Nature. Sep. 11, 2008;455(7210):237-41. Epub Jul. 30, 2008.
Thompson. Applications of antisense and siRNAs during preclinical drug development. Drug Discov Today. Sep. 1, 2002;7(17):912-7.
Thorpe, et al. Improved antitumor effects of immunotoxins prepared with deglycosylated ricin A-chain and hindered disulfide linkages. Cancer Res. Nov. 15, 1988;48(22):6396-403.
Van Goor, et al. Correction of the F508del-CFTR protein processing defect in vitro by the investigational drug VX-809. Proc Natl Acad Sci U S A. Nov. 15, 2011;108(46):18843-8. Epub Oct. 5, 2011.
Van Goor, et al. Rescue of CF airway epithelial cell function in vitro by a CFTR potentiator, VX-770. Proc Natl Acad Sci U S A. Nov. 3, 2009; 106(44):18825-30. Epub Oct. 21, 2009.
Vaughan, et al. Genetics of Parkinsonism: a review. Ann Hum Genet. Mar. 2001;65(Pt 2):111-26.
Vickers, et al. Efficient reduction of target RNAs by small interfering RNA and RNase H-dependent antisense agents. A comparative analysis. J Biol Chem. Feb. 28, 2003;278(9):7108-18. Epub Dec. 23, 2002.
Vissers, et al. Array-based comparative genomic hybridization for the genomewide detection of submicroscopic chromosomal abnormalities. Am. J. Hum. Genet. 2003; 73:1261-70.
Vissers, et al. Identification of disease genes by whole genome CGH arrays. Hum Mol Genet. Oct. 15, 2005; 14 Spec No. 2:R215-223.
Walsh, et al. Detection of inherited mutations for breast and ovarian cancer using genomic capture and massively parallel sequencing. Proc Natl Acad Sci U S A. Jul. 13, 2010;107(28):12629-33. Epub Jun. 28, 2010.
Walsh, et al. Spectrum of mutations in BRCA1, BRCA2, CHEK2, and TP53 in families at high risk of breast cancer. JAMA. Mar. 22, 2006;295(12):1379-88.
Walters, et al. A new highly penetrant form of obesity due to deletions on chromosome 16p11.2. Nature. Feb. 4, 2010;463(7281):671-5.
Wang, et al. Antisense anticancer oligonucleotide therapeutics. Curr Cancer Drug Targets. Nov. 2001;1(3):177-96.
Weiss, et al. Association between microdeletion and microduplication at 16p11.2 and autism. N Engl J Med. Feb. 14, 2008;358(7):667-75.
Wilson, et al. DNA copy-number analysis in bipolar disorder and schizophrenia reveals aberrations in genes involved in glutamate signaling. Hum Mol Genet. Mar. 1, 2006; 15(5):743-9. Epub Jan. 24, 2006.
Xia, et al. siRNA-mediated gene silencing in vitro and in vivo. Nat Biotechnol. Oct. 2002;20(10):1006-10. Epub Sep. 16, 2002.
Xie, et al. CNV-seq, a new method to detect copy number variation using high-throughput sequencing. BMC Bioinformatics. Mar. 6, 2009;10:80.
Yusa, et al. Targeted gene correction of α1-antitrypsin deficiency in induced pluripotent stem cells. Nature. Oct. 12, 2011;478(7369):391-4. doi: 10.1038/nature10424.
Zhang, et al. Copy number variation in human health, disease, and evolution. Annu Rev Genomics Hum Genet. 2009;10:451-81.

(56) References Cited

OTHER PUBLICATIONS

Zhang, et al. Detection of copy number variation from array intensity and sequencing read depth using a stepwise Bayesian model. BMC Bioinformatics. Oct. 31, 2010;11:539.
International search report and written opinion dated Jan. 20, 2014 for PCT/US2013/059739.
NCBI. GenBank accession No. AL390798.3. Human chromosome 14 DNA sequence BAC R-21O19 of library RPCI-11 from chromosome 14 of *Homo sapiens* (Human), complete sequence. Apr. 28, 2011.
Betancur, et al. The emerging role of synaptic cell-adhesion pathways in the pathogenesis of autism spectrum disorders. Trends Neurosci. Jul. 2009;32(7):402-12. doi: 10.1016/j.tins.2009.04.003. Epub Jun. 21, 2009.
Office action dated Dec. 16, 2014 for U.S. Appl. No. 12/449,566.
Daruwala, et al. A versatile statistical analysis algorithm to detect genome copy number variation. Proc Natl Acad Sci U S A. Nov. 16, 2004;101(46):16292-7. Epub Nov. 8, 2004.
European search report and opinion dated Feb. 27, 2015 for EP Application No. 11814903.8.
European search report and opinion dated Jun. 9, 2015 for EP Application No. 12846660.4.
U.S. Appl. No. 14/449,217, filed Aug. 1, 2014, Hatchwell et al.
Notice of allowance dated Jul. 25, 2014 for U.S. Appl. No. 13/196,882.
Office action dated May 28, 2014 for U.S. Appl. No. 12/449,566.
Alexander Zimprich, et al., A mutation in, encoding a subunit of the retromer complex, causes late-onset Parkinson disease, American journal of human genetics, American society of human genetics. Jun. 2011; 89(1):168-175.
Carles Vilario-Guell, et al., Mutations in Parkinson disease, American journal of human genetics, American society of human genetics. Jun. 2011; 89(1):162-167.
Kumar Kishore, et al., Genetics of Parkinson disease and other movement disorders, Current opinion in neurology, Aug. 2012; 25(4):466-474.
Office Action dated Sep. 15, 2016 for U.S. Appl. No. 13/763,550.
Office Action dated Oct. 19, 2016 for European Application No. 12846660.4.
Office Action dated Dec. 6, 2016 for U.S. Appl. No. 14/026,642.
Paisan-Ruiz Coro, et al., Parkinson's disease and low frequency alleles found together throughout LRRK2, Annals of human genetics. Jul. 2009. 73(4). 391-403.
Co-pending U.S. Appl. No. 15/279,012, filed Sep. 28, 2016.
Corti, et al. What Genetics tells us about the causes and mechanisms of parkinson's disease. Physiological reviews.Oct. 2011; 91(4):1161-1218.
European Search Report dated Sep. 2, 2016 for European Application No. 13836501.0.
"Introducing Genome-Wide SNP Array 6.0 Pure performance & Genetic Power." May 21, 2008. Available at http://www.genehk.com/news/doc/Genomics_genome-wide Human SNP Array 6.0.pdf. Accessed on Dec. 22, 2016.
Lucentini. Gene association typically wrong reproducible gene-disease associations are few and far between. The Scientist, Dec. 20, 2004, p. 20.
Office Action dated Feb. 24, 2016 for U.S. Appl. No. 14/039,770.
Office Action dated May 27, 2015 for U.S. Appl. No. 14/039,770.
UK Parkinson's Disease Consortium et al., Dissection of the genetics of parkinson's disease identifies an additional association 5' of SNCA and multiple associated haplotypes at 17q21. Human Molecular genetics. Jan. 15, 2011; 20(2): 345-353.
Abravaya, et al. Detection of point mutations with a modified ligase chain reaction (Gap-LCR). Nucleic Acids Research. 1995;23(4):675-682.
Arakawa, et al. Advances in characterization of neuroprotective peptide, humanin. Curr Med Chem. 2011;18(36):5554-63.
Bangham, et al. Diffusion of univalent ions across the lamellae of swollen phospholipids. J Mol Biol. Aug. 1965;13(1):238-52.

Bernard, et al. Sequence of the murine and human cellular myc oncogenes and two modes of myc transcription resulting from chromosome translocation in B lymphoid tumours. EMBO J. 1983;2(12):2375-83.
Bodzioch, et al. Evidence for potential functionality of nuclearly-encoded humanin isoforms. Genomics. Oct. 2009;94(4):247-56. Epub May 27, 2009.
Bremer, et al. Copy number variation characteristics in subpopulations of patients with autism spectrum disorders. Am J Med Genet B Neuropsychiatr Genet. Mar. 2011;156(2):115-24. doi: 10.1002/ajmg.b.31142. Epub Dec. 8, 2010.
Culture of Animal Cells: A Manual of Basic Technique by R. Ian Freshney, Publisher: Wiley-Liss; 5th edition (2005).
De Krom, et al. A common variant in DRD3 receptor is associated with autism spectrum disorder. Biol Psychiatry. Apr. 1, 2009;65(7):625-30. doi: 10.1016/j.biopsych.2008.09.035. Epub Dec. 5, 2008.
Dijkhuizen, et al. Fish and array-CGH analysis of a complex chromosome 3 aberration suggests that loss of CNTN4 and CRBN contributes to mental retardation in 3pter deletions. Am J Med Genet A. Nov. 15, 2006;140(22):2482-7.
Encode project consortium, et al. An integrated encyclopedia of DNA elements in the human genome. Nature. Sep. 6, 2012;489(7414):57-74. doi: 10.1038/nature11247.
European search report and opinion dated Feb. 11, 2015 for EP Application No. 12839712.2.
European search report dated Oct. 14, 2015 for EP Application No. 13746934.2.
Fernandez, et al. Gene Discovery in Developmental Neuropsychiatric Disorders: Clues from Chromosomal Rearrangements. Yale Journal of Biology and Medicine, vol. 78 (2005), pp. 95-130. on p. 103. Abstract.
Gagneux, et al. Genetic differences between humans and great apes. Mol Phylogenet. Evol. Jan. 2001;18(1):2-13.
Gatto, et al. Genetic controls balancing excitatory and inhibitory synaptogenesis in neurodevelopmental disorder models. Frontiers in Synaptic Neuroscience. Jun. 2010; 2(4):1-19.
Gelmann, et al. Identification of reciprocal translocation sites within the c-myc oncogene and immunoglobulin mu locus in a Burkitt lymphoma. Nature. Dec. 22, 1983-Jan. 4, 1984;306(5945):799-803.
GeneCards output for ATXN2 gene, from www.genecards.ord, pritned on May 20, 2015, pp. 1-13.
GeneCards output for DIAPH2 gene, from www.genecards.ord, printed on Jun. 11, 2015, pp. 1-11.
GPHN Gene—GeneCards output. pp. 1-14. Printed on Jul. 2, 2015 from www.genecards.org.
Gregoriadis. Chapter 14, "Liposomes," Drug Carriers in Biology and Medicine, pp. 2.sup.87-341 (Academic Press, 1979).
Griswold, et al. A de novo 1.5 Mb microdeletion on chromosome 14q23.2-23.3 in a patient with autism and spherocytosis. Autism Res. Jun. 2011;4(3):221-7. doi: 10.1002/aur.186. Epub Feb. 28, 2011.
Guatelli, et al. Isothermal, in vitro amplification of nucleic acids by a multienzyme reaction modeled after retroviral replication. Proc Natl Acad Sci U S A. Mar. 1990;87(5):1874-8.
Hattersley, et al. What makes a good genetic association study? Lancet. Oct. 8, 2005;366(9493):1315-23.
Hegele. SNP judgments and freedom of association. Arterioscler Thromb Vasc Biol. Jul. 1, 2002;22(7):1058-61.
Hirschhorn, et al. A comprehensive review of genetic association studies. Genet Med. Mar.-Apr. 2002;4(2):45-61.
Human Genome CGH Microarrays—Details & Specifications, six printed pages from www.agilent.com, printed on May 20, 2015.
International search report and written opinion dated Jan. 15, 2014 for PCT/US2013/062346.
International search report and written opinion dated Apr. 9, 2012 for PCT/US2011/001363.
International search report and written opinion dated Jun. 21, 2013 for PCT/IB2012/002498.
International search report and written opinion dated Jul. 3, 2013 for PCT/IB2012/002498.
Juppner. Functional properties of the PTH/PTHrP receptor. Bone. Aug. 1995; 17(2):Supplement 39S-42S.

(56) References Cited

OTHER PUBLICATIONS

Knight, et al. A cytogenetic abnormality and rare coding variants identify ABCA13 as a candidate gene in schizophrenia, bipolar disorder, and depression. Am J Hum Genet. Dec. 2009;85(6):833-46. doi: 10.1016/j.ajhg.2009.11.003.
Kwoh, et al. Transcription-based amplification system and detection of amplified human immunodeficiency virus type 1 with a bead-based sandwich hybridization format. Proc Natl Acad Sci U S A. Feb. 1989;86(4):1173-7.
Landegren, et al. A ligase-mediated gene detection technique. Science. Aug. 26, 1988;241(4869):1077-80.
Lizardi, et al. Exponential amplification of recombinant-RNA hybridization probes. Nature Biotechnology 6.10 (1988): 1197-1202.
Lucentini, et al. Gene association studies typically wrong. Reproducible gene-disease associations are few and far between. The Scientist. 2004; 18(24):20.
Maftei, et al. Interaction structure of the complex between neuroprotective factor humanin and Alzheimer's β-amyloid peptide revealed by affinity mass spectrometry and molecular modeling. J Pept Sci. Jun. 2012;18(6):373-82. doi: 10.1002/psc.2404. Epub Apr. 20, 2012.
Maniatis, et al. Molecular Cloning: A Laboratory Manual, Cold Spring Harbor Laboratory Press, Cold Spring Harbor, N.Y., USA (1982).
Marshall, et al. Structural variation of chromosomes in autism spectrum disorder. Am J Hum Genet. Feb. 2008;82(2):477-88. doi: 10.1016/j.ajhg.2007.12.009. Epub Jan. 17, 2008.
Matsuoka, et al. Humanin and the receptors for humanin. Mol Neurobiol. Feb. 2010;41(1):22-8. Epub Dec. 9, 2009.
McInnes, et al. A large-scale survey of the novel 15q24 microdeletion syndrome in autism spectrum disorders identifies an atypical deletion that narrows the critical region. Mol Autism. Mar. 19, 2010;1(1):5. doi: 10.1186/2040-2392-1-5.
Mohapatra, et al. Analyses of brain tumor cell lines confirm a simple model of relationships among fluorescence in situ hybridization, DNA index, and comparative genomic hybridization. Genes Chromosomes Cancer. Dec. 1997;20(4):311-9.
Mummidi, et al. Evolution of human and non-human primate CC chemokine receptor 5 gene and mRNA. Potential roles for haplotype and mRNA diversity, differential haplotype-specific transcriptional activity, and altered transcription factor binding to polymorphic nucleotides in the pathogenesis of HIV-1 and simian immunodeficiency virus. J Biol Chem. Jun. 23, 2000;275(25):18946-61.
Nakazawa, et al. UV and skin cancer: specific p53 gene mutation in normal skin as a biologically relevant exposure measurement. Proc Natl Acad Sci U S A. Jan. 4, 1994;91(1):360-4.
NCBI GenBank accession No. NG_12385.1. Mar. 27, 2012.
Office action dated Feb. 25, 2016 for U.S. Appl. No. 13/648,874.
Office action dated Feb. 29, 2016 for U.S. Appl. No. 14/026,642.
Office action dated Mar. 1, 2016 for U.S. Appl. No. 13/763,550.
Office action dated Jun. 23, 2015 for U.S. Appl. No. 13/763,550.
Office action dated Jun. 29, 2015 for U.S. Appl. No. 14/026,642.
Office action dated Jul. 9, 2015 for U.S. Appl. No. 13/648,874.
Office action dated Sep. 2, 2015 for U.S. Appl. No. 12/449,566.
Pennisi. A closer look at SNPs suggests difficulties. Science. Sep. 18, 1998; 281(5384): 1787-1789.
Petrini, et al. The immunoglobulin heavy chain switch: structural features of gamma. 1 recombinant switch regions. J Immunol. Mar. 15, 1987;138(6):1940-6.
Pinto, et al. Comprehensive assessment of array based platforms and calling algorithms for detection of copy number variants. Nat Biotechnol. May 8, 2011;29(6):512-20. doi: 10.1038/nbt.1852.
Pinto, et al. Functional impact of global rare copy number variation in autism spectrum disorders. Nature. Jul. 15, 2010;466(7304):368-72. Epub Jun. 9, 2010.
Rees, et al. Isoform heterogeneity of the human gephyrin gene (GPHN), binding domains to the glycine receptor, and mutation analysis in hyperekplexia. J Biol Chem. Jul. 4, 2003;278(27):24688-96. Epub Apr. 8, 2003.
Remington "The Science and Practice of Pharmacy" (20th Ed., Lippincott Williams & Wilkins, Baltimore MD).
Risch, et al. A genomic screen of autism: evidence for a multilocus etiology. Am J Hum Genet. Aug. 1999;65(2):493-507.
Saiki, et al. Primer-directed enzymatic amplification of DNA with a thermostable DNA polymerase. Science. Jan. 29, 1988;239(4839):487-91.
Sambrook et al., Molecular Cloning: A Laboratory Manual (2 ed.), Cold Spring Harbor Laboratory Press, Cold Spring Harbor, N.Y., USA (1989).
Sudhof. Neuroligins and neurexins link synaptic function to cognitive disease. Nature. Oct. 16, 2008;455(7215):903-11. doi: 10.1038/nature07456.
Szoka, et al. Procedure for preparation of liposomes with large internal aqueous space and high capture by reverse-phase evaporation. Proc Natl Acad Sci U S A. Sep. 1978;75(9):4194-8.
Tabuchi, et al. A neuroligin-3 mutation implicated in autism increases inhibitory synaptic transmission in mice. Science. Oct. 5, 2007;318(5847):71-6. Epub Sep. 6, 2007.
The Merck Manual of Diagnosis and Therapy, 18th Edition, published by Merck Research Laboratories, 2006 (ISBN 0-911910-18-2).
Urnov, et al. Genome editing with engineered zinc finger nucleases. Nat Rev Genet. Sep. 2010;11(9):636-46.
Veensra-Vanderweele, et al. Networking in autism: leveraging genetic, biomarker and model system findings in the search for new treatments. Neuropsychopharmacology. Jan. 2012;37(1):196-212. doi: 10.1038/npp.2011.185. Epub Sep. 21, 2011.
Westmark, C. What's hAPPening at synapses? The role of amyloid β-protein precursor and β-amyloid in neurological disorders. Mol Psychiatry. Aug. 28, 2012. doi: 10.1038/mp.2012.122.
Zapala, et al. Humanins, the neuroprotective and cytoprotective peptides with antiapoptotic and anti-inflammatory properties. Pharmacol Rep. Sep.-Oct. 2010;62(5):767-77.
Crespi, et al. Association testing of copy number variants in schizophrenia and autism spectrum disorders. J Neurodev Disord. May 30, 2012;4(1):15. doi: 10.1186/1866-1955-4-15.
European search report dated Apr. 11, 2016 for EP Application No. 13840476.9.
Guilmatre, et al. Recurrent rearrangements in synaptic and neurodevelopmental genes and shared biologic pathways in schizophrenia, autism, and mental retardation. Arch Gen Psychiatry. Sep. 2009;66(9):947-56. doi: 10.1001/archgenpsychiatry.2009.80.
He, et al. Analysis of de novo copy number variations in a family affected with autism spectrum disorders using high-resolution array-based comparative genomic hybridization. Zhonghua Yi Xue Yi Chuan Xue Za Zhi. Jun. 2012;29(3):266-9. doi: 10.3760/cma.j.issn.1003-9406.2012.03.004. English abstract only.
Prasad, et al. A discovery resource of rare copy number variations in individuals with autism spectrum disorder. G3 (Bethesda). Dec. 2012;2(12):1665-85. doi: 10.1534/g3.112.004689. Epub Dec. 1, 2012.
Tam, et al. The role of DNA copy number variation in schizophrenia. Biol Psychiatry. Dec. 1, 2009;66(11):1005-12. doi: 10.1016/j.biopsych.2009.07.027. Epub Sep. 12, 2009.
Ziats, et al. Expression profiling of autism candidate genes during human brain development implicates central immune signaling pathways. PLoS One. 2011;6(9):e24691. doi: 10.1371/journal.pone.0024691. Epub Sep. 15, 2011.
Office action dated May 17, 2016 for U.S. Appl. No. 14/090,932.
Office action dated Jun. 28, 2016 for U.S. Appl. No. 12/449,566.
O'Keefe, et al. High-resolution genomic arrays facilitate detection of novel cryptic chromosomal lesions in myelodysplastic syndromes. Exp Hematol. Feb. 2007;35(2):240-51.
CNV: 14q23.3 summary output from https://gene.sfari.org/database/cnv/14q23.3 Nov. 30, 2017, pp. 1-3. (year: 2017).
Copy Number Variants summary for 12q23.3-q24.13 from gene.sfari.org/database/cnv/, two pages printed on Dec. 2, 2017. (Year:2017).
Kaminsky, et al., An evidence-based approach to establish the functional and clinical significance of copy number variants in intellectual and developmental disabilities. Genetics in medicine, 2011; 13(9): 777-784.
Office Action dated Oct. 10, 2017 for U.S. Appl. No. 14/449,217.
Office Action dated Oct. 13, 2017 for U.S. Appl. No. 14/806,131.
Office Action dated Dec. 5, 2017 for U.S. Appl. No. 13/648,874.

(56) References Cited

OTHER PUBLICATIONS

Office Action dated Dec. 11, 2017 for U.S. Appl. No. 13/763,550.
Office Action dated Dec. 7, 2017 for U.S. Appl. No. 14/039,770.
Sanders, et al., Multiple Recurrent De Novo CNVs, including duplications of the 7q11.23 Williams Syndrome Region, Are Strongly Associated with Autism. Neuron. Jun. 9, 2011; 70: 863-885.
Chen, et al., Correlation between SMN2 copies and the phenotype of spinal muscular atrophy. Chin J Neurol, Nov. 30, 2005; 38(11):673-676.
Co-pending U.S. Appl. No. 16/029,125, filed Jul. 6, 2018.
Fang et al., "Clinical and genetic features of patients with sporadic amyotrophic lateral sclerosis in south-west China", Amyotrophic Lateral Sclerosis, vol. 10, 350-354, 2009.
Gokcumen, et al., Copy number variants (CNVs) in primate species using array-based comparative genomic hybridization. Methods 2009;49:18-25.
Greenway et al., "ANG mutations segregate with familial and "sporadic" amyotrophic lateral sclerosis", Nature Genetics, vol. 38, No. 4, 411-413, Apr. 2006.
Munoz-Amatriain et al., Distribution, functional impact, and origin mechanisms of copy number variation in the barley genome. Genome Biology, 2013; 14:r58 pp. 1-17.
R Del Bo et al., "DPP6 gene variability confers increased risk of developing sporadic amyotrophic lateral sclerosis in Italian patients", Journal of Neurology, Neurosurgery and Psychiatry, vol. 79, No. 9, p. 1085, Sep. 2008.
Saeed et al., "Paraoxonase cluster polymorphisms are associated with sporadic ALS", Neurology, vol. 67, 771-776, 2006.
Wei Du, PhD Thesis, Cleveland State University, "Role of KCNMA1 in the Pathogenesis of GEPD Syndrome",1-127, Nov. 2009, etd.ohiolink.edu/letd.send_file?accession=csu1272045934&disposition=inline.
U.S. Appl. No. 12/449,566 Notice of Allowance dated Oct. 27, 2018.
U.S. Appl. No. 13/648,874 Notice of Allowance dated Oct. 4, 2018.
U.S. Appl. No. 14/039,770 Notice of Allowance dated Sep. 27, 2018.
U.S. Appl. No. 14/090,932 Office Action dated Feb. 16, 2018.
U.S. Appl. No. 12/449,566 Office Action dated Feb. 23, 2018.
U.S. Appl. No. 13/763,550 Office Action dated Jun. 6, 2018.
U.S. Appl. No. 14/090,932 Office Action dated Sep. 27, 2018.
U.S. Appl. No. 14/449,217 Notice of Allowance dated Apr. 11, 2018.
U.S. Appl. No. 14/806,131 Office Action dated Jun. 21, 2018.
Van Es et al., "Genetic variation in DPP is associated with susceptibility to amyotrophic lateral sclerosis", Nature Genetics, vol. 40, No. 1, 29-31, Jan. 2008.
Alexander Zimprich et al., "A Mutation in VPS35, Encoding a Subunitof the Retromer Complex, CausesLate-Onset Parkinson Disease", American Journal of Human Genetics, vol. 89, No. 1, Jun. 21, 2011, p. 168-175.
Carles Vilario-Guell et al.,"VPS35 Mutations in Parkinson Disease", American Journal of Human Genetics, vol. 89, No. 1, Jun. 1, 2011 p. 162-167.
Coro Paisa'n-Ruiz et al., "Parkinson's Disease and Low Frequency Alleles Found Together Throughout LRRK2", Annals of Human Genetics, Jul. 2009, vol. 73, No. Pt. 4, p. 391-403.
Eli Hatchwell, "Is there a (host) genetic predisposition to progressive multifocal leukoencephalopathy?", Frontiers in Immunology, vol. 6, May 11, 2015 p. 2-3.
Kishore R. Kumar et al., "Genetics of Parkinson disease and othermovement disorders", Current Opinion in Neurology, vol. 25, No. 4 Aug. 2012 p. 466-474.
Subhash Pokharel et al., "High-Throughput Screening for Functional Adenosine to Inosine R A Editing Systems", ACS Chemical Biology, vol. 1, No. 12 Dec. 1, 2006, p. 761-765.
Ching, et al., Integrated analysis of copy number and loss of heterozygosity in primary breast carcinomas using high-density SNP array. International journal of oncology, 2011; 39:621-633.
Langston, et al., Multisystem Lewy body disease and the other parkinsonian disorders. Nature Genetics. Dec. 2015; 47(12):1378-1385.
Liu, Qing-Rong, et al. "Addiction molecular genetics: 639,401 SNP whole genome association identifies many "cell adhesion" genes." American Journal of Medical Genetics Part B: Neuropsychiatric Genetics val. 141 (2006): pp. 918-925.
Office Action dated Apr. 13, 2017 for U.S. Appl. No. 13/648,874.
Office Action dated Apr. 13, 2017 for U.S. Appl. No. 14/039,770.
Office Action dated May 25, 2017 for U.S. Appl. No. 13/763,550.
Office Action dated Aug. 11, 2017 for U.S. Appl. No. 14/026,642.
Poewe, et al., Parkinson disease. Nature Review:Disease Primers. Mar. 23, 2017. vol. 3, Article 17013: 1-21.
Purcell et al. "Postmortem brain abnormalities of the glutamate neurotransmitter system in autism" (Neurology, vol. 57 (2001) pp. 1618-1628).
Zeng, Li, et al. "A novel splice variant of the cell adhesion molecule contactin 4 (CNTN4) is mainly expressed in human brain." Journal of human genetics val. 47 (2002): pp. 497-499.

* cited by examiner

METHODS FOR DETECTING A GENETIC VARIATION IN ATTRACTIN-LIKE 1 (ATRNL1) GENE IN SUBJECT WITH PARKINSON'S DISEASE

CROSS-REFERENCE

This application claims the benefit of U.S. Provisional Application No. 61/556,043, filed Nov. 4, 2011, U.S. Provisional Application No. 61/556,077, filed Nov. 4, 2011, and U.S. Provisional Application No. 61/743,920, filed Sep. 14, 2012 which applications are incorporated herein by reference in their entirety.

STATEMENT AS TO FEDERALLY SPONSORED RESEARCH

This invention was made with government support under NS065559 awarded by the National Institutes of Health. The government has certain rights in the invention.

REFERENCE TO A SEQUENCE LISTING

The present application includes a Sequence Listing in computer readable form. A compact disc labeled "COPY 1" contains the Sequence Listing file named Combined_patent_ST25.txt. The Sequence Listing is 242,343,936 KB in size and was recorded on Nov. 2, 2012. The compact disc is 1 of 3 compact discs. Duplicate copies of the compact disc are labeled "COPY 2" and "COPY 3." The compact disc and duplicate copies are identical and are hereby incorporated by reference into the present application.

BACKGROUND OF THE INVENTION

Genetic risk can be conferred by subtle differences in individual genomes within a population. Genes can differ between individuals due to genomic variability, the most frequent of which are due to single nucleotide polymorphisms (SNPs). SNPs can be located, on average, every 500-1000 base pairs in the human genome. Additional genetic polymorphisms in a human genome can be caused by duplication, insertion, deletion, translocation and/or inversion, of short and/or long stretches of DNA. Thus, in general, genetic variability among individuals occurs on many scales, ranging from single nucleotide changes, to gross changes in chromosome structure and function. Recently, many copy number variations (CNVs) of DNA segments, including deletions, insertions, duplications, amplifications, and complex multi-site variants, ranging in length from kilobases to megabases in size, have been discovered (Redon, R. et al. Nature 444:444-54 (2006) and Estivill, X. & Armengol, L. PLoS Genetics 3(10): e190 (2007)). To date, known CNVs account for over 15% of the assembled human genome (Estivill, X. Armengol, L. PLoS Genetics 3(10): e190 (2007)). However, a majority of these variants are extremely rare and cover a small percentage of a human genome of any particular individual.

Parkinson's Disease (also known as Parkinson disease, Parkinson's, idiopathic parkinsonism, primary parkinsonism, PD, or paralysis agitans) is a degenerative disorder of the central nervous system. Parkinson's disease (PD) can be characterized by a progressive degeneration of dopaminergic neurons in the midbrain. While PD is a complex disorder of unknown etiology, it is postulated that symptom manifestation occurs after the fraction of functional dopaminergic cells falls below a threshold of twenty percent. Symptoms of PD can include tremor, muscular rigidity, bradykinesia, akinesia, and postural instability. A hallmark of idiopathic or sporadic Parkinson's disease can be the progressive loss of dopaminergic neurons and a depletion of dopamine, more specifically in the basal ganglia, and is thought to result from a combination of genetic predisposition (Vaughn, J. R., et al., 2001, Ann. Hum. Genet. 65:111), and environmental factors (Shapira, A. H., 2001, Adv. Neurol. 86:155). Thus, research efforts have focused on discovering means to prevent, protect and restore the dopaminergic cell network (Latchman, D. S., et al., 2001 Rev. Neurosci. 12:69). As genetic polymorphisms conferring risk neurological diseases, including PD, are uncovered, genetic testing can play a role for clinical therapeutics.

Despite these advances towards an understanding of the etiology of neurological disorders, a large fraction of the genetic contribution to these disorders, for example, PD, remains undetermined. Identification of underlying genetic variants that can contribute to neurological disorder pathogenesis can aid in the screening and identification of individuals at risk of developing these disorders and can be useful in a diagnostic setting and for disease management. There is a need to identify new treatments for neurological diseases, such as PD, and the identification of novel genetic risk factors can assist in the development of potential therapeutics and agents. There is also a need for improved assays for predicting and determining potential treatments and their effectiveness.

INCORPORATION BY REFERENCE

All publications, patents, and patent applications mentioned in this specification are herein incorporated by reference to the same extent as if each individual publication, patent, or patent application was specifically and individually indicated to be incorporated by reference. In the event of a conflict between a term herein and a term incorporated by reference, the term herein controls.

BRIEF DESCRIPTION OF THE DRAWINGS

The novel features of the disclosure are set forth with particularity in the appended claims. A better understanding of the features and advantages of the present disclosure can be obtained by reference to the following detailed description that sets forth illustrative embodiments, in which the principles of the disclosure are utilized, and the accompanying drawings.

SUMMARY OF THE INVENTION

Figure 1:
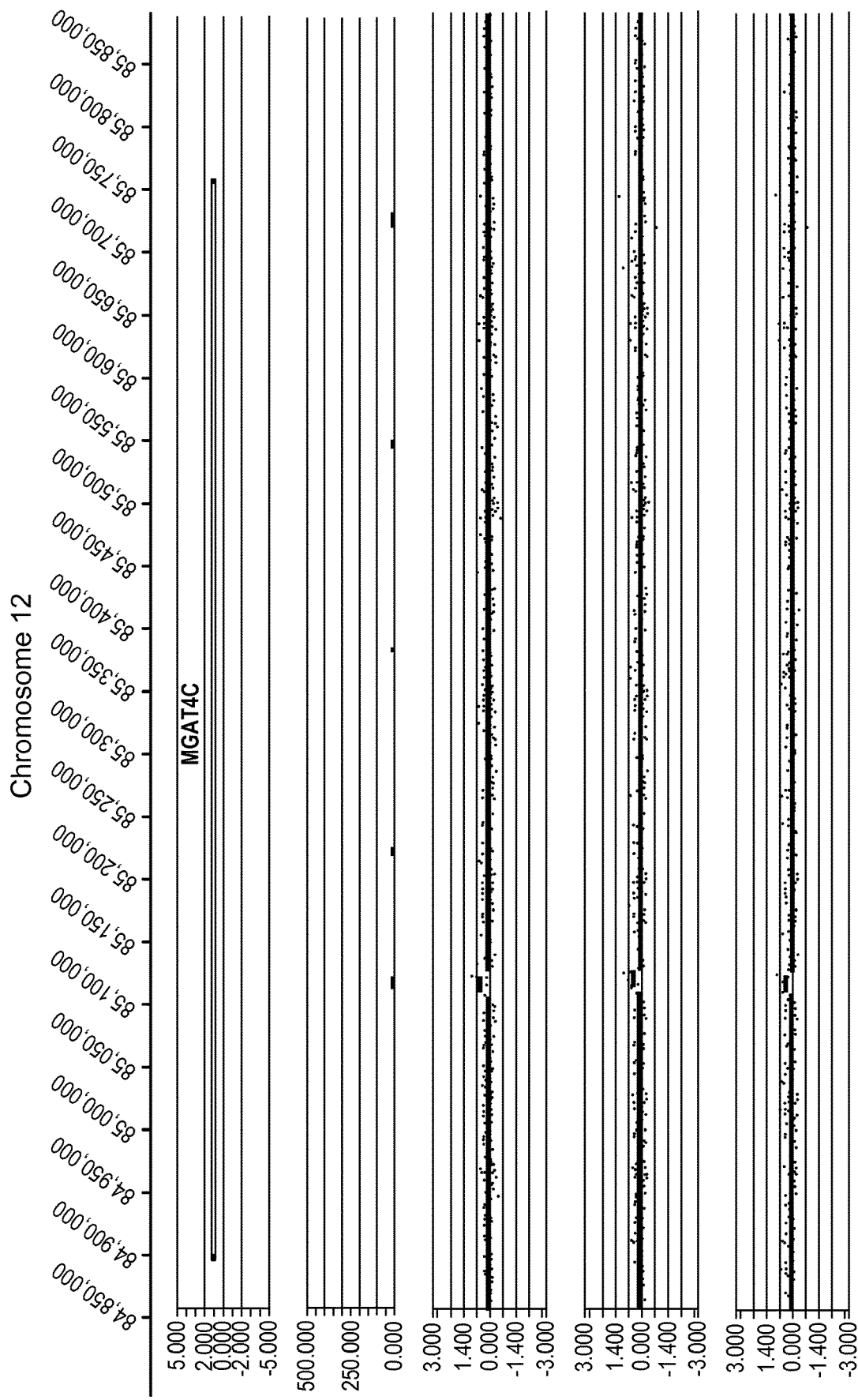
FIG. 1 is an example of a copy number gain occurring in three PD cases that disrupts the MGAT4C gene and represents an example of aCNV-subregion that overlaps a known gene, and is associated with an OR of at least 6. The CNV is a gain (log 2 ratio>0.35) and affects the gene MGAT4C on chromosome 12. The calculated odds ratio (OR) for this CNV-subregion is 6.48.

An aspect of the invention includes a method of screening one or more subjects for at least one genetic variation that disrupts or modulates one or more genes in Table 2 or 3, comprising: assaying at least one nucleic acid sample obtained from each of the one or more subjects for the at least one genetic variation in one or more genes in Table 2 or 3. In some embodiments, the at least one genetic variation is associated with a neurological disorder (ND). In some embodiments, the at least one genetic variation is one encoded by SEQ ID NOs 1 to 382. In some embodiments, the at least one genetic variation comprises one or more point mutations, polymorphisms, translocations, insertions, deletions, amplifications, inversions, microsatellites, interstitial deletions, copy number variations (CNVs), or any combination thereof. In some embodiments, the at least one genetic variation disrupts or modulates one or more genomic sequences of SEQ ID NOs 383 to 1020. In some embodiments, the at least one genetic variation disrupts or modulates the expression or function of one or more RNA transcripts, one or more polypeptides, or a combination thereof, expressed from the one or more genomic sequences of SEQ ID NOs 383 to 1020. In some embodiments, the assaying comprises detecting nucleic acid information from the at least one nucleic acid sample. In some embodiments, the nucleic acid information is detected by one or more methods selected from the group comprising PCR, sequencing, Northern blots, or any combination thereof. In some embodiments, the sequencing comprises one or more high-throughput sequencing methods. In some embodiments, the one or more high throughput sequencing methods comprise Massively Parallel Signature Sequencing (MPSS), polony sequencing, 454 pyrosequencing, Illumina sequencing, SOLiD sequencing, ion semiconductor sequencing, DNA nanoball sequencing, heliscope single molecule sequencing, single molecule real time (SMRT) sequencing, RNAP sequencing, Nanopore DNA sequencing, sequencing by hybridization, or microfluidic Sanger sequencing. In some embodiments, the at least one nucleic acid sample is collected from blood, saliva, urine, serum, tears, skin, tissue, or hair from the one or more subjects. In some embodiments, the assaying the at least one nucleic acid sample of the one or more subjects comprises purifying nucleic acids from the at least one nucleic acid sample. In some embodiments, the assaying the at least one nucleic acid sample of the one or more subjects comprises amplifying at least one nucleotide sequence in the at least one nucleic acid sample. In some embodiments, the assaying the at least one nucleic acid sample for at least one genetic variation comprises a microarray analysis of the at least one nucleic acid sample. In some embodiments, the microarray analysis comprises a CGH array analysis. In some embodiments, the CGH array detects the presence or absence of the at least one genetic variations. In some embodiments, the method further comprises determining whether the one or more subjects has a ND, or an altered susceptibility to an ND. In some embodiments, the one or more subjects were previously diagnosed or are suspected as having the ND. In some embodiments, the diagnostic or grounds for suspicion that the subject may have ND is based on an evaluation by a medical doctor, a psychologist, a neurologist, a psychiatrist, or other professionals who screen subjects for an ND. In some embodiments, the determining comprises an evaluation of the one or more subject's motor skills, autonomic function, neuropsychiatry, mood, cognition, behavior, thoughts, ability to sense, or a combination thereof. In some embodiments, the evaluation comprises observation, a questionnaire, a checklist, a test, or a combination thereof. In some embodiments, the evaluation comprises a neurological exam, the subject's past medical history, an exam to test the sense of smell, or a combination thereof. In some embodiments, the screening the one or more subjects further comprises selecting one or more therapies based on the presence or absence of the one or more genetic variations. In some embodiments, the assaying at least one nucleic acid sample obtained from each of the one or more subjects comprises analyzing the whole genome or whole exome from the one or more subjects. In some embodiments, the nucleic acid information has already been obtained for the whole genome or whole exome from the one or more individuals and the nucleic acid information is obtained from in silico analysis. In some embodiments, the ND is Parkinson's Disease (PD). In some embodiments, the one or more subjects have at least one symptom of an ND. In some embodiments, the at least one symptom comprises unilateral onset, tremor at rest, progression in time, asymmetry of motor symptoms, response to levodopa for at least five years, clinical course of at least ten years, and appearance of dyskinesias induced by the intake of excessive levodopa, problems learning, multiple system atrophy, progressive supranuclear palsy, corticobasal degeneration and dementia with Lewy bodies, accumulation of alpha-synuclein protein in the brain in the form of Lewy bodies, dementia, neurofibrillary tangles, tremor, rigidity, slowness of movement, postural instability, "pill-rolling", Bradykinesia, difficulties planning a movement, difficulties initiating a movement, difficulties executing a movement, difficulties performing sequential movements, difficulties performing simultaneous movements, difficulties tuning fine motor control uniform rigidity, ratchet rigidity, joint pain, reduced the ability to move, postural instability, impaired balance, frequently falling, gait disturbances, posture disturbances, festination, speech disturbances, swallowing disturbances, voice disorders, mask-like face expression, small handwriting, executive dysfunction, planning problems, cognitive flexibility problems, abstract thinking problems, rule acquisition problems, initiating appropriate action problems, inhibiting inappropriate action problems, and problems selecting relevant sensory information, fluctuation in attention, slowed cognitive speed, reduced memory, problems recalling learned information, visuospatial difficulties, depression, apathy, anxiety, impulse control behavior problems, craving, binge eating, hypersexuality, pathological gambling, hallucinations, delusions, daytime drowsiness, disturbances in REM sleep, insomnia, orthostatic hypotension, oily skin, excessive sweating, urinary incontinence, altered sexual function, constipation, gastric dysmotility, decreased blink rate, dry eyes, deficient ocular pursuit, saccadic movements, difficulties in directing gaze upward, blurred vision, double vision, impaired sense of smell, sensation of pain, paresthesia, reduced activity of dopamine-secreting cells, or a combination thereof. In some embodiments, the one or more subjects are human. In some embodiments, the one or more subjects are more than 40 years old, more than 50 years old, more than 60 years old, or more than 70 years old.

An aspect of the invention includes a method of diagnosing one or more first subjects for an ND, comprising: assaying at least one nucleic acid sample of each of the one or more subjects for the presence or absence of at least one genetic variation in one or more genes in Table 2 or 3. In some embodiments, the at least one genetic variation is one encoded by at least one of SEQ ID NOs 1-382. In some embodiments, the one or more first subjects is diagnosed with the ND if the at least one genetic variation is present.

In some embodiments, the one or more first subjects is not diagnosed with ND if the at least one genetic variation is absent. In some embodiments, the assaying comprises detecting nucleic acid information from the at least one nucleic acid sample. In some embodiments, the nucleic acid information is detected by one or more methods selected from the group comprising PCR, sequencing, Northern blots, hybridization, or any combination thereof. In some embodiments, the sequencing comprises one or more high-throughput sequencing methods. In some embodiments, the one or more high throughput sequencing methods comprise Massively Parallel Signature Sequencing (MPSS), polony sequencing, 454 pyrosequencing, Illumina sequencing, SOLiD sequencing, ion semiconductor sequencing, DNA nanoball sequencing, heliscope single molecule sequencing, single molecule real time (SMRT) sequencing, RNAP sequencing, Nanopore DNA sequencing, sequencing by hybridization, or microfluidic Sanger sequencing. In some embodiments, the method further comprises determining whether the one or more first subjects has an ND or an altered susceptibility to an ND. In some embodiments, the one or more first subjects were previously diagnosed or are suspected as having the ND based on an evaluation by a psychologist, a neurologist, a psychiatrist, a speech therapist, or other professionals who screen subjects for an ND. In some embodiments, the determining comprises an evaluation of the one or more first subject's motor skills, autonomic function, neuropsychiatry, mood, cognition, behavior, thoughts, ability to sense, or a combination thereof. In some embodiments, the evaluation comprises observation, a questionnaire, a checklist, a test, or a combination thereof. In some embodiments, the evaluation comprises a neurological exam, the subject's past medical history, an exam to test the sense of smell, or a combination thereof. In some embodiments, the determining comprises comparing the nucleic acid information of the one or more first subjects to nucleic acid information of one or more second subjects. In some embodiments, the one more second subjects comprise one or more subjects not suspected of having the ND. In some embodiments, the one or more second subjects comprise one or more subjects suspected of having the ND. In some embodiments, the one or more first subjects comprise one or more subjects with the ND. In some embodiments, the one or more second subjects comprise one or more subjects without the ND. In some embodiments, the one or more first subjects comprise one or more subjects who are symptomatic for the ND. In some embodiments, the one or more second subjects comprise one or more subjects who are asymptomatic for the ND. In some embodiments, the one or more first subjects comprise one or more subjects that have an increased susceptibility to the ND. In some embodiments, the one or more second subjects comprise one or more subjects that have a decreased susceptibility to the ND. In some embodiments, the one or more first subjects comprise one or more subjects receiving a treatment, therapeutic regimen, or any combination thereof for an ND. In some embodiments, determining whether the one or more subjects have the ND or an altered susceptibility to the ND comprises analyzing at least one behavioral analysis of the one or more subjects and the nucleic acid sequence information of the one or more subjects, or a combination thereof. In some embodiments, wherein the at least one nucleic acid sample is collected from blood, saliva, urine, serum, tears, skin, tissue, or hair from the one or more subjects. In some embodiments, assaying comprises purifying nucleic acids from the at least one nucleic acid sample. In some embodiments, assaying comprises amplifying at least one nucleotide sequence in the at least one nucleic acid sample. In some embodiments, assaying comprises a microarray analysis of the at least one nucleic acid sample. In some embodiments, the microarray analysis comprises a CGH array analysis. In some embodiments, the CGH array detects the presence or absence of the at least one genetic variations. In some embodiments, the at least one genetic variation comprises one or more point mutations, polymorphisms, translocations, insertions, deletions, amplifications, inversions, microsatellites, interstitial deletions, copy number variations (CNVs), or any combination thereof. In some embodiments, the at least one genetic variation comprises a loss of heterozygosity. In some embodiments, the at least one genetic variation disrupts or modulates one or more genomic sequences of SEQ ID NOs 383 to 1020. In some embodiments, the at least one genetic variation disrupts or modulates the expression or function of one or more RNA transcripts from the one or more genomic sequences of SEQ ID NOs 383 to 1020. In some embodiments, the method further comprises selecting one or more therapies based on the presence or absence of the one or more genetic variations. In some embodiments, the assaying at least one nucleic acid sample obtained from each of the one or more subjects comprises analyzing the whole genome or whole exome from the one or more subjects. In some embodiments, the nucleic acid information has already been obtained for the whole genome or whole exome from the one or more individuals and the nucleic acid information is obtained from in silico analysis. In some embodiments, the ND is PD. In some embodiments, the one or more subjects has at least one symptom of an ND. In some embodiments, the at least one symptom comprises unilateral onset, tremor at rest, progression in time, asymmetry of motor symptoms, response to levodopa for at least five years, clinical course of at least ten years, and appearance of dyskinesias induced by the intake of excessive levodopa, problems learning, multiple system atrophy, progressive supranuclear palsy, corticobasal degeneration and dementia with Lewy bodies, accumulation of alpha-synuclein protein in the brain in the form of Lewy bodies, dementia, neurofibrillary tangles, tremor, rigidity, slowness of movement, postural instability, "pill-rolling", Bradykinesia, difficulties planning a movement, difficulties initiating a movement, difficulties executing a movement, difficulties performing sequential movements, difficulties performing simultaneous movements, difficulties tuning fine motor control uniform rigidity, ratchet rigidity, joint pain, reduced the ability to move, postural instability, impaired balance, frequently falling, gait disturbances, posture disturbances, festination, speech disturbances, swallowing disturbances, voice disorders, mask-like face expression, small handwriting, executive dysfunction, planning problems, cognitive flexibility problems, abstract thinking problems, rule acquisition problems, initiating appropriate action problems, inhibiting inappropriate action problems, and problems selecting relevant sensory information, fluctuation in attention, slowed cognitive speed, reduced memory, problems recalling learned information, visuospatial difficulties, depression, apathy, anxiety, impulse control behavior problems, craving, binge eating, hypersexuality, pathological gambling, hallucinations, delusions, daytime drowsiness, disturbances in REM sleep, insomnia, orthostatic hypotension, oily skin, excessive sweating, urinary incontinence, altered sexual function, constipation, gastric dysmotility, decreased blink rate, dry eyes, deficient ocular pursuit, saccadic movements, difficulties in directing gaze upward, blurred vision, double vision, impaired sense of smell, sensation of pain, paresthesia, reduced activity of dopamine-secreting cells, or a combination thereof. In some embodiments, the one or more subjects are human. In some embodiments, the one or more subjects is more than 40 years old, more than 50 years old, more than 60 years old, or more than 70 years old.

An aspect of the invention includes a method of screening for a therapeutic agent for treatment of an ND, comprising identifying an agent that disrupts or modulates one or more genomic sequences of SEQ ID NOs 383 to 1020 or one or more expression products thereof. In some embodiments, the one or more expression products comprise one or more RNA transcripts. In some embodiments, the one or more RNA transcripts comprise one or more RNA transcripts of Table 4. In some embodiments, the one or more expression products comprise one or more polypeptides. In some embodiments, the one or more polypeptides are translated from one or more RNA transcripts of Table 4. In some embodiments, disrupting or modulating the one or more genomic sequences of SEQ ID NOs 383 to 1020 or expression products thereof, comprises an increase in expression of the one or more expression products. In some embodiments, disrupting or modulating the one or more genomic sequences of SEQ ID NOs 383 to 1020 or expression products thereof, comprises a decrease in expression of the one or more expression products.

An aspect of the invention includes a method of treating a subject for an ND, comprising administering one or more agents to disrupt or modulate one or more genomic sequences of SEQ ID NOs 383 to 1020 or one or more expression products thereof, thereby treating the ND. In some embodiments, the one or more expression products comprise one or more RNA transcripts. In some embodiments, the one or more RNA transcripts comprise one or more RNA transcripts of Table 4. In some embodiments, the one or more expression products comprise one or more polypeptides. In some embodiments, the one or more polypeptides are translated from one or more RNA transcripts of Table 4. In some embodiments, the one or more agents are selected from the group comprising: an antibody, a drug, a combination of drugs, a compound, a combination of compounds, radiation, a genetic sequence, a combination of genetic sequences, heat, cryogenics, and a combination of two or more of any combination thereof. In some embodiments, the ND is PD. In some embodiments, the one or more subjects has at least one symptom of a ND. In some embodiments, the at least one symptom comprises unilateral onset, tremor at rest, progression in time, asymmetry of motor symptoms, response to levodopa for at least five years, clinical course of at least ten years, and appearance of dyskinesias induced by the intake of excessive levodopa, problems learning, multiple system atrophy, progressive supranuclear palsy, corticobasal degeneration and dementia with Lewy bodies, accumulation of alpha-synuclein protein in the brain in the form of Lewy bodies, dementia, neurofibrillary tangles, tremor, rigidity, slowness of movement, postural instability, "pill-rolling", Bradykinesia, difficulties planning a movement, difficulties initiating a movement, difficulties executing a movement, difficulties performing sequential movements, difficulties performing simultaneous movements, difficulties tuning fine motor control uniform rigidity, ratchet rigidity, joint pain, reduced the ability to move, postural instability, impaired balance, frequently falling, gait disturbances, posture disturbances, festination, speech disturbances, swallowing disturbances, voice disorders, mask-like face expression, small handwriting, executive dysfunction, planning problems, cognitive flexibility problems, abstract thinking problems, rule acquisition problems, initiating appropriate action problems, inhibiting inappropriate action problems, and problems selecting relevant sensory information, fluctuation in attention, slowed cognitive speed, reduced memory, problems recalling learned information, visuospatial difficulties, depression, apathy, anxiety, impulse control behavior problems, craving, binge eating, hypersexuality, pathological gambling, hallucinations, delusions, daytime drowsiness, disturbances in REM sleep, insomnia, orthostatic hypotension, oily skin, excessive sweating, urinary incontinence, altered sexual function, constipation, gastric dysmotility, decreased blink rate, dry eyes, deficient ocular pursuit, saccadic movements, difficulties in directing gaze upward, blurred vision, double vision, impaired sense of smell, sensation of pain, paresthesia, reduced activity of dopamine-secreting cells, or a combination thereof. In some embodiments, the one or more subjects is human. In some embodiments, the one or more subjects is more than 40 years old, more than 50 years old, more than 60 years old, or more than 70 years old.

An aspect of the invention includes a kit for screening for an ND in one or more subjects, the kit comprising reagents for assaying a nucleic acid sample from the one or more subjects for the presence of at least one genetic variation encoded by SEQ ID NOs 1-382.

In some embodiments, the at least one genetic variation disrupts or modulates one or more genomic sequences of SEQ ID NOs 383 to 1020, or one or more expression products thereof. In some embodiments, the one or more expression products comprise one or more RNA transcripts. In some embodiments, the one or more RNA transcripts comprise one or more RNA transcripts of Table 4. In some embodiments, the one or more expression products comprise one or more polypeptides. In some embodiments, the one or more polypeptides are translated from one or more RNA transcripts of Table 4. In some embodiments, the reagents comprise nucleic acid probes. In some embodiments, the reagents comprise oligonucleotides. In some embodiments, the reagents comprise primers. In some embodiments, the ND is PD. In some embodiments, the one or more subjects has at least one symptom of an ND. In some embodiments, the one or more subjects is human. In some embodiments, the one or more subjects is more than 40 years old, more than 50 years old, more than 60 years old, or more than 70 years old.

An aspect of the invention includes an isolated polynucleotide sequence or fragment thereof, comprising at least 60% identity to any of polynucleotide sequence of SEQ ID NOs 1 to 1020. In some embodiments, the isolated polynucleotide sequence comprises at least 70% identity to any of polynucleotide sequence of SEQ ID NOs 1 to 1020. In some embodiments, the isolated polynucleotide sequence comprises at least 80% identity to any of polynucleotide sequence of SEQ ID NOs 1 to 1020. In some embodiments, the isolated polynucleotide sequence comprises at least 90% identity to any of polynucleotide sequence of SEQ ID NOs 1 to 1020.

An aspect of the invention includes an isolated polynucleotide sequence comprising at least 60% identity to a compliment of any of polynucleotide sequence of SEQ ID NOs 1 to 1020. In some embodiments, the isolated polynucleotide sequence comprises at least 70% identity to a compliment of any of polynucleotide sequence of SEQ ID NOs 1 to 1020. In some embodiments, the isolated polynucleotide sequence comprises at least 80% identity to a compliment of any of polynucleotide sequence of SEQ ID NOs 1 to 1020. In some embodiments, the isolated polynucleotide sequence comprises at least 90% identity to a compliment of any of polynucleotide sequence of SEQ ID NOs 1 to 1020. In some embodiments, the polynucleotide sequence comprises any of a CNV of SEQ ID NOs 1-382. In some embodiments, the polynucleotide sequence comprises any of a genomic sequence of SEQ ID NOs 383 to 1020.

In some embodiments, the sequence comprises an RNA sequence transcribed from a genomic sequence of SEQ ID NOs 383 to 1020. In some embodiments, the polynucleotide sequence comprises any of genetic variation not present in the human genome. In some embodiments, the polynucleotide sequence fragment comprises a nucleic acid probe. In some embodiments, the nucleic acid probe is capable of hybridization to a nucleic acid of interest. In some embodiments, the polynucleotide sequence fragment comprises a nucleic acid primer. In some embodiments, the nucleic acid primer is capable of initiation of extension or amplifying of a nucleic acid of interest.

An aspect of the invention includes an isolated polypeptide encoded by an RNA sequence transcribed from any of genomic sequence of SEQ ID NOs 383 to 1020.

An aspect of the invention includes a host cell comprising an expression control sequence operably linked to a polynucleotide selected from the group consisting of any of polynucleotide sequence of SEQ ID NOs 383 to 1020, or a fragment thereof. In some embodiments, the expression control sequence is non-native to the host cell. In some embodiments, the expression control sequence is native to the host cell.

An aspect of the invention includes a method for identifying an agent having a therapeutic benefit for treatment of an ND, comprising: a) providing cells comprising at least one genetic variation of SEQ ID NOs 1 to 382; b) contacting the cells of step a) with a test agent and c) analyzing whether the agent has a therapeutic benefit for treatment of the ND of step a), thereby identifying agents which have a therapeutic benefit for treatment of the ND. In some embodiments, the method further comprises: d) providing cells which do not comprise at least one genetic variation of SEQ ID NOs 1-382; e) contacting the cells of steps a) and d) with a test agent; and f) analyzing whether the agent has a therapeutic benefit for treatment of the ND of step a) relative to those of step b), thereby identifying agents which have a therapeutic benefit for treatment of the ND. In some embodiments, the therapeutic agent has efficacy for the treatment of an ND.

An aspect of the invention includes a therapeutic agent identified by the method of any one of claims 124-126.

An aspect of the invention includes a panel of biomarkers for an ND comprising one or more genes contained in the one or more polynucleotide sequences selected from SEQ ID NOs 383 to 1020. In some embodiments, the panel comprises two or more genes contained in the one or more polynucleotide sequences selected from SEQ ID NOs 383 to 1020. In some embodiments, the panel comprises at least 5, 10, 25, 50, 100 or 200 genes contained in the one or more polynucleotide sequences selected from SEQ ID NOs 383 to 1020. In some embodiments, at least one of the polynucleotide sequences is a fragment of the one-more polynucleotide sequences selected from SEQ ID NOs 383 to 1020. In some embodiments, at least one of the polynucleotide sequences is a variant of the one-more polynucleotide sequences selected from SEQ ID NOs 383 to 1020. In some embodiments, the panel is selected for analysis of polynucleotide expression levels for an ND. In some embodiments, the polynucleotide expression levels are mRNA expression levels. In some embodiments, the panel is used in the management of patient care for an ND, wherein the management of patient care includes one or more of risk assessment, early diagnosis, prognosis establishment, patient treatment monitoring, and treatment efficacy detection. In some embodiments, the panel is used in discovery of therapeutic intervention of an ND. In some embodiments, at least one of the biomarkers is attached to substrate. In some embodiments, the substrate comprises a plastic, glass, a bead, or a plate. In some embodiments, at least one of the biomarkers is labeled with a detectable label. In some embodiments, the panel is an in silico panel.

An aspect of the invention includes a method for measuring expression levels of polynucleotide sequences from biomarkers for an ND in a subject, comprising: a) selecting a panel of biomarkers comprising two or more genes contained in one or more polynucleotide sequences selected from SEQ ID NOs 383 to 1020; b) isolating cellular RNA from a nucleic acid sample obtained from the subject; c) synthesizing cDNA from the cellular RNA for each biomarker in the panel using suitable primers; d) optionally amplifying the cDNA; and e) quantifying levels of the cDNA from the nucleic acid sample. In some embodiments, the step of selecting a panel of biomarkers comprises at least 5, 10, 25, 50, 100 or 200 genes contained in one or more polynucleotide sequences selected from SEQ ID NOs 383 to 1020. In some embodiments, the step of quantifying the levels of cDNA further comprises labeling cDNA. In some embodiments, labeling cDNA comprises labeling with at least one chromophore. In some embodiments, the cDNA levels for the nucleic acid sample are compared to a control cDNA level. In some embodiments, the comparison is used in the management of patient care in ND. In some embodiments, the management of patient care includes one or more of risk assessment, early diagnosis, establishing prognosis, monitoring patient treatment, and detecting treatment efficacy. In some embodiments, the comparison is used in discovery of therapeutic intervention of an ND.

An aspect of the invention includes a method for measuring expression levels of polypeptides comprising: a) selecting a panel of biomarkers comprising at least two polypeptides encoded by an RNA sequence transcribed from a genomic sequence of SEQ ID NOs 383 to 1020; b) obtaining a nucleic acid sample; c) creating an antibody panel for each biomarker in the panel; d) using the antibody panel to bind the polypeptides from the nucleic acid sample; and e) quantifying levels of the polypeptides bound from the nucleic acid sample to the antibody panel. In some embodiments, the polypeptide levels of the nucleic acid sample are increased or decreased compared to the polypeptide levels of a control nucleic acid sample. In some embodiments, the subject is treated for an ND patient based on the quantified levels of the polypeptides bound from the nucleic acid sample to the antibody panel. In some embodiments, the treatment of a subject includes one or more of risk assessment, early diagnosis, establishing prognosis, monitoring patient treatment, and detecting treatment efficacy. In some embodiments, the comparison is used in discovery of a therapeutic intervention of an ND.

An aspect of the invention includes a kit for the determination of an ND comprising: at least one reagent that is used in analysis of one or more polynucleotide expression levels for a panel of biomarkers for an ND, wherein the panel comprises two or more genes contained in one or more polynucleotide sequences selected from SEQ ID NOs 383 to 1020, and instructions for using the kit for analyzing the expression levels. In some embodiments, the one or more polynucleotide expression levels comprise one or more RNA transcript expression levels. In some embodiments, the one or more RNA transcript expression levels correspond to one or more RNA transcripts of Table 4. In some embodiments, the at least one reagent comprises at least two sets of suitable primers. In some embodiments, the at least one reagent comprises a reagent for the preparation of cDNA. In some embodiments, the at least one reagent comprises a reagent that is used for detection and quantization of polynucleotides. In some embodiments, the at least one reagent comprises at least one chromophore.

An aspect of the invention includes a kit for the determination of an ND comprising: at least one reagent that is used in analysis of polypeptide expression levels for a panel of biomarkers for ND, wherein the panel comprises at least two polypeptides expressed from two or more genes contained in one or more polynucleotide sequences selected from SEQ ID NOs 383 to 1020; and instructions for using the kit for analyzing the expression levels. In some embodiments, the reagent is an antibody reagent that binds a polypeptide selected in the panel. In some embodiments, the kit further comprises a reagent that is used for detection of a bound polypeptide. In some embodiments, the reagent includes a second antibody.

An aspect of the invention includes a method of screening a subject for an ND, the method comprising: a) assaying a nucleic acid sample obtained from the subject by PCR, array Comparative Genomic Hybridization, sequencing, SNP genotyping, or Fluorescence in Situ Hybridization to detect sequence information for more than one genetic loci; b) comparing the sequence information to a panel of nucleic acid biomarkers, wherein the panel comprises at least one nucleic acid biomarker for each of the more than one genetic loci; and wherein the panel comprises at least 2 low frequency nucleic acid biomarkers, wherein the low frequency nucleic acid biomarkers occur at a frequency of 0.1% or less in a population of subjects without a diagnosis of the ND; and c) screening the subject for the presence or absence of the ND if one or more of the low frequency biomarkers in the panel are present in the sequence information. In some embodiments, the panel comprises at least 5, 10, 25, 50, 100 or 200 low frequency nucleic acid biomarkers. In some embodiments, the presence or absence of the ND in the subject is determined with at least 50% confidence. In some embodiments, the low frequency biomarkers occur at a frequency of 0.01% or less, 0.001% or less, or 0.0001% or less in a population of subjects without a diagnosis of the ND. In some embodiments, the panel of nucleic acid biomarkers comprises at least two genes contained in the one or more polynucleotide sequences selected from SEQ ID NOs 383 to 1020. In some embodiments, the ND is PD. In some embodiments, the method further comprises identifying a therapeutic agent useful for treating the ND.

In some embodiments, the method further comprises administering one or more of the therapeutic agents to the subject if one or more of the low frequency biomarkers in the panel are present in the sequence information.

An aspect of the invention includes a kit for screening a subject for an ND, the kit comprising at least one reagent for assaying a nucleic acid sample from the subject for information on a panel of nucleic acid biomarkers, wherein the panel comprises at least 2 low frequency biomarkers, and wherein the low frequency biomarkers occur at a frequency of 0.1% or less in a population of subjects without a diagnosis of the ND. In some embodiments, a presence or absence of the ND in the subject is determined with a 50% confidence. In some embodiments, the panel comprises at least 5, 10, 25, 50, 100 or 200 low frequency nucleic acid biomarkers. In some embodiments, the low frequency biomarkers occur at a frequency of 0.01% or less, 0.001% or less, or 0.0001% or less in a population of subjects without a diagnosis of the ND. In some embodiments, the panel of nucleic acid biomarkers comprises at least two genes contained in the one or more polynucleotide sequences selected from SEQ ID NOs 383 to 1020. In some embodiments, the at least one reagent comprises at least two sets of suitable primers. In some embodiments, the at least one reagent comprises a reagent for the preparation of cDNA. In some embodiments, the at least one reagent comprises a reagent that is used for detection and quantization of polynucleotides. In some embodiments, the at least one reagent comprises at least one chromophore.

An aspect of the invention includes a method of generating a panel of nucleic acid biomarkers comprising: a) assaying a nucleic acid sample from a first population of subjects by PCR, array Comparative Genomic Hybridization, sequencing, SNP genotyping, or Fluorescence in Situ Hybridization for nucleic acid sequence information, wherein the subjects of the first population have a diagnosis of an ND; b) assaying a nucleic acid sample from a second population of subjects by PCR, array Comparative Genomic Hybridization, sequencing, SNP genotyping, or Fluorescence in Situ Hybridization for nucleic acid sequence information, wherein the subjects of the second population are without a diagnosis of an ND; c) comparing the nucleic acid sequence information from step (a) to that of step (b); d) determining the frequency of one or more biomarkers from the comparing step; and e) generating the panel of a nucleic acid biomarkers, wherein the panel comprises at least 2 low frequency biomarkers, and wherein the low frequency biomarkers occur at a frequency of 0.1% or less in a population of subjects without a diagnosis of an ND. In some embodiments, the subjects in the second population of subjects without a diagnosis of an ND comprise one or more subjects not suspected of having the ND. In some embodiments, the subjects in the second population of subjects without a diagnosis of an ND comprise one or more subjects without the ND. In some embodiments, the subjects in the second population of subjects without a diagnosis of an ND comprise one or more subjects who are asymptomatic for the ND. In some embodiments, the subjects in the second population of subjects without a diagnosis of an ND comprise one or more subjects who have decreased susceptibility to the ND. In some embodiments, the subjects in the second population of subjects without a diagnosis of an ND comprise one or more subjects who are unassociated with a treatment, therapeutic regimen, or any combination thereof. In some embodiments, the panel comprises at least 5, 10, 25, 50, 100 or 200 low frequency nucleic acid biomarkers. In some embodiments, the low frequency biomarkers occur at a frequency of 0.01% or less, 0.001% or less, or 0.0001% or less in the second population of subjects without a diagnosis of an ND. In some embodiments, the panel of nucleic acid biomarkers comprises at least two genes contained in the one or more polynucleotide sequences selected from SEQ ID NOs 383 to 1020.

An aspect of the invention includes an array comprising a plurality of nucleic acid probes, wherein each probe comprises a sequence complimentary to a target sequence of one of the polynucleotide sequences selected from SEQ ID NOs 1 to 1020, or a fragment thereof. In some embodiments, the plurality of nucleic acid probes comprises at least 5, 10, 25, 50, 100 or 200 of the nucleic acid probes. In some embodiments, the array further comprises a second plurality of nucleic acid probes, wherein each probe in the second plurality of nucleic acid probes comprises a sequence complimentary to a complimentary target sequence of one of the polynucleotide sequences selected from SEQ ID NOs 1 to 1020, or a fragment thereof. In some embodiments, the second plurality of nucleic acid probes comprises at least 5, 10, 25, 50, 100 or 200 nucleic acid probes. In some embodiments, each different nucleic acid probe is attached to a bead. In some embodiments, each different nucleic acid probe is labeled with a detectable label. In some embodiments, each different nucleic acid probe is attached to a solid support in a determinable location of the array. In some embodiments, the solid support comprises plastics, glass, beads, microparticles, microtiter dishes, or gels. In some embodiments, the array further comprises control probes.

DETAILED DESCRIPTION OF THE INVENTION

The details of one or more inventive embodiments are set forth in the accompanying drawings, the claims, and in the description herein. Other features, objects, and advantages of inventive embodiments disclosed and contemplated herein will be apparent from the description and drawings, and from the claims. As used herein, unless otherwise indicated, the article "a" means one or more unless explicitly otherwise provided for. As used herein, unless otherwise indicated, terms such as "contain," "containing," "include," "including," and the like mean "comprising." As used herein, unless otherwise indicated, the term "or" can be conjunctive or disjunctive. As used herein, unless otherwise indicated, any embodiment can be combined with any other embodiment. As used herein, unless otherwise indicated, some inventive embodiments herein contemplate numerical ranges. When ranges are present, the ranges include the range endpoints. Additionally, every subrange and value within the range is present as if explicitly written out.

Described herein are methods of identifying variations in nucleic acids and genes associated with one or more neurological conditions. Described herein are methods of screening for determining a subject's susceptibility to developing or having one or more neurological disorders, for example, Parkinson's disease (PD), based on identification and detection of genetic nucleic acid variations. Also described herein, are methods and compositions for treating and/or preventing one or more neurological conditions using a therapeutic modality. The present disclosure encompasses methods of assessing an individual for probability of response to a therapeutic agent for a neurological disorder, methods for predicting the effectiveness of a therapeutic agent for a neurological disorder, nucleic acids, polypeptides and antibodies and computer-implemented functions. Kits for screening a nucleic acid sample from a subject to detect or determine susceptibility to a neurological disorder are also encompassed by the disclosure.

Genetic Variations Associated with Neurological Disorders

Genomic sequences within populations exhibit variability between individuals at many locations in the genome. For example, the human genome exhibits sequence variations that occur on average every 500 base pairs. Such genetic variations in nucleic acid sequences are commonly referred to as polymorphisms or polymorphic sites. As used herein, a polymorphism, e.g. genetic variation, includes a variation in the sequence of a gene in the genome amongst a population, such as allelic variations and other variations that arise or are observed. Thus, a polymorphism refers to the occurrence of two or more genetically determined alternative sequences or alleles in a population. These differences can occur in coding and non-coding portions of the genome, and can be manifested or detected as differences in nucleic acid sequences, gene expression, including, for example transcription, processing, translation, transport, protein processing, trafficking, DNA synthesis; expressed proteins, other gene products or products of biochemical pathways or in post-translational modifications and any other differences manifested amongst members of a population. A single nucleotide polymorphism (SNP) includes to a polymorphism that arises as the result of a single base change, such as an insertion, deletion or change in a base. A polymorphic marker or site is the locus at which divergence occurs. Such site can be as small as one base pair (an SNP). Polymorphic markers include, but are not limited to, restriction fragment length polymorphisms, variable number of tandem repeats (VNTR's), hypervariable regions, minisatellites, dinucleotide repeats, trinucleotide repeats, tetranucleotide repeats and other repeating patterns, simple sequence repeats and insertional elements, such as Alu. Polymorphic forms also are manifested as different mendelian alleles for a gene. Polymorphisms can be observed by differences in proteins, protein modifications, RNA expression modification, DNA and RNA methylation, regulatory factors that alter gene expression and DNA replication, and any other manifestation of alterations in genomic nucleic acid or organelle nucleic acids.

In some embodiments, these genetic variations can be found to be associated with one or more disorders and/or diseases using the methods disclosed herein. In some embodiments the one or more disorders and/or diseases comprise one or more neurological disorders. In some embodiments the one or more neurological disorders comprise one or more neurodegenerative disorders (NDs). In some embodiments, the one or more NDs comprise Parkinson's Disease (PD). In some embodiments genetic variations can be associated with one or more NDs.

Scientific evidence suggests there is a potential for various combinations of factors causing PD, such as multiple genetic variations that may cause PD. As used herein, "Parkinson's disease" includes idiopathic Parkinson's disease and Parkinson's disease that can be attributed to known genetic variations, and Parkinson's disease associated with other factors for which no causal relationship has been proven. As used herein, "genetic variations" include point mutations, polymorphisms, translocations, insertions, deletions, amplifications, inversions, interstitial deletions, copy number variations (CNVs), loss of heterozygosity, or any combination thereof. As genetic variation includes any deletion, insertion or base substitution of the genomic DNA of one or more individuals in a first portion of a total population which thereby results in a difference at the site of the deletion, insertion or base substitution relative to one or more individuals in a second portion of the total population. Thus, the term "genetic variation" encompasses "wild type"

or the most frequently occurring variation, and also includes "mutant," or the less frequently occurring variation.

As used herein, a target molecule that is "associated with" or "correlates with" a particular genetic variation is a molecule that can be functionally distinguished in its structure, activity, concentration, compartmentalization, degradation, secretion, and the like, as a result of such genetic variation. In some embodiments polymorphisms (e.g. polymorphic markers, genetic variations, or genetic variants) can comprise any nucleotide position at which two or more sequences are possible in a subject population. In some embodiments, each version of a nucleotide sequence with respect to the polymorphism can represent a specific allele, of the polymorphism. In some embodiments, genomic DNA from a subject can contain two alleles for any given polymorphic marker, representative of each copy of the marker on each chromosome. In some embodiments, an allele can be a nucleotide sequence of a given location on a chromosome. Polymorphisms can comprise any number of specific alleles. In some embodiments of the disclosure, a polymorphism can be characterized by the presence of two or more alleles in a population. In some embodiments, the polymorphism can be characterized by the presence of three or more alleles. In some embodiments, the polymorphism can be characterized by four or more alleles, five or more alleles, six or more alleles, seven or more alleles, nine or more alleles, or ten or more alleles. In some embodiments an allele can be associated with one or more diseases or disorders, for example, a neurological disorder risk allele can be an allele that is associated with increased or decreased risk of developing a neurological disorder. In some embodiments, genetic variations and alleles can be used to associate an inherited phenotype, for example, a neurological disorder, with a responsible genotype. In some embodiments, a neurological disorder risk allele can be a variant allele that is statistically associated with a screening of one or more neurological disorders. In some embodiments, genetic variations can be of any measurable frequency in the population, for example, a frequency higher than 10%, a frequency between 5-10%, a frequency between 1-5%, or frequency below 1%. As used herein, variant alleles can be alleles that differ from a reference allele. As used herein, a variant can be a segment of DNA that differs from the reference DNA, such as a genetic variation. In some embodiments, genetic variations can be used to track the inheritance of a gene that has not yet been identified, but whose approximate location is known.

As used herein, a "haplotype" can be information regarding the presence or absence of one or more genetic markers in a given chromosomal region in a subject. In some embodiments, a haplotype can be a segment of DNA characterized by one or more alleles arranged along the segment, for example, a haplotype can comprise one member of the pair of alleles for each genetic variation or locus. In some embodiments, the haplotype can comprise two or more alleles, three or more alleles, four or more alleles, five or more alleles, or any combination thereof, wherein, each allele can comprise one or more genetic variations along the segment.

In some embodiments, a genetic variation can be a functional aberration that can alter gene function, gene expression, polypeptide expression, polypeptide function, or any combination thereof. In some embodiments, a genetic variation can be a loss-of-function mutation, gain-of-function mutation, dominant negative mutation, or reversion. In some embodiments, a genetic variation can be part of a gene's coding region or regulatory region. Regulatory regions can control gene expression and thus polypeptide expression. In some embodiments, a regulatory region can be a segment of DNA wherein regulatory polypeptides, for example, transcription factors, can bind. In some embodiments a regulatory region can be positioned near the gene being regulated, for example, positions upstream of the gene being regulated. In some embodiments, a regulatory region (e.g., enhancer element) can be several thousands of base pairs upstream or downstream of a gene.

In some embodiments, variants can include changes that affect a polypeptide, such as a change in expression level, sequence, function, localization, binding partners, or any combination thereof. In some embodiments, a genetic variation can be a frameshift mutation, nonsense mutation, missense mutation, neutral mutation, or silent mutation. For example, sequence differences, when compared to a reference nucleotide sequence, can include the insertion or deletion of a single nucleotide, or of more than one nucleotide, resulting in a frame shift; the change of at least one nucleotide, resulting in a change in the encoded amino acid; the change of at least one nucleotide, resulting in the generation of a premature stop codon; the deletion of several nucleotides, resulting in a deletion of one or more amino acids encoded by the nucleotides; the insertion of one or several nucleotides, such as by unequal recombination or gene conversion, resulting in an interruption of the coding sequence of a reading frame; duplication of all or a part of a sequence; transposition; or a rearrangement of a nucleotide sequence. Such sequence changes can alter the polypeptide encoded by the nucleic acid, for example, if the change in the nucleic acid sequence causes a frame shift, the frame shift can result in a change in the encoded amino acids, and/or can result in the generation of a premature stop codon, causing generation of a truncated polypeptide. In some embodiments, a genetic variation associated with a neurological disorder can be a synonymous change in one or more nucleotides, for example, a change that does not result in a change in the amino acid sequence. Such a polymorphism can, for example, alter splice sites, affect the stability or transport of mRNA, or otherwise affect the transcription or translation of an encoded polypeptide. In some embodiments, a synonymous mutation can result in the polypeptide product having an altered structure due to rare codon usage that impacts polypeptide folding during translation, which in some cases may alter its function and/or drug binding properties if it is a drug target. In some embodiments, the changes that can alter DNA increase the possibility that structural changes, such as amplifications or deletions, occur at the somatic level. A polypeptide encoded by the reference nucleotide sequence can be a reference polypeptide with a particular reference amino acid sequence, and polypeptides encoded by variant nucleotide sequences can be variant polypeptides with variant amino acid sequences.

In some embodiments, one or more variant polypeptides can be associated with one or more diseases or disorders, such as PD. In some embodiments, variant polypeptides and changes in expression, localization, and interaction partners thereof, can be used to associate an inherited phenotype, for example, a neurological disorder, with a responsible genotype. In some embodiments, a neurological disorder associated variant polypeptide can be statistically associated with a diagnosis, prognosis, or theranosis of one or more neurological disorders.

The most common sequence variants comprise base variations at a single base position in the genome, and such sequence variants, or polymorphisms, are commonly called single nucleotide polymorphisms (SNPs) or single nucleotide variants (SNVs). In some embodiments, a SNP represents a genetic variant present at greater than or equal to 1% occurrence in a population and in some embodiments a SNP can represent a genetic variant present at any frequency level in a population. A SNP can be a nucleotide sequence variation occurring when a single nucleotide at a location in the genome differs between members of a species or between paired chromosomes in a subject. SNPs can include variants of a single nucleotide, for example, at a given nucleotide position, some subjects can have a 'G', while others can have a 'C'. SNPs can occur in a single mutational event, and therefore there can be two possible alleles possible at each SNP site; the original allele and the mutated allele. SNPs that are found to have two different bases in a single nucleotide position are referred to as biallelic SNPs, those with three are referred to as triallelic, and those with all four bases represented in the population are quadallelic. In some embodiments, SNPs can be considered neutral. In some embodiments SNPs can affect susceptibility to neurological disorders. SNP polymorphisms can have two alleles, for example, a subject can be homozygous for one allele of the polymorphism wherein both chromosomal copies of the individual have the same nucleotide at the SNP location, or a subject can be heterozygous wherein the two sister chromosomes of the subject contain different nucleotides. The SNP nomenclature as reported herein is the official Reference SNP (rs) ID identification tag as assigned to each unique SNP by the National Center for Biotechnological Information (NCBI).

Another genetic variation of the disclosure can be copy number variations (CNVs). As used herein, "CNVs" include alterations of the DNA of a genome that results an abnormal number of copies of one or more sections of DNA. In some embodiments, a CNV comprises a CNV-subregion. As used herein, a "CNV-subregion includes a continuous nucleotide sequence within a CNV. In some embodiments, the nucleotide sequence of a CNV-subregion can be shorter than the nucleotide sequence of the CNV. CNVs can be inherited or caused by de novo mutation and can be responsible for a substantial amount of human phenotypic variability, behavioral traits, and disease susceptibility. In a preferred embodiment, CNVs of the current disclosure can be associated with susceptibility to one or more neurological disorders, for example, Parkinson's Disease. In some embodiments, CNVs can include a single gene or include a contiguous set of genes. In some embodiments, CNVs can be caused by structural rearrangements of the genome, for example, translocations, insertions, deletions, amplifications, inversions, and interstitial deletions. In some embodiments, these structural rearrangements occur on one or more chromosomes. Low copy repeats (LCRs), which are region-specific repeat sequences, can be susceptible to these structural rearrangements, resulting in CNVs. Factors such as size, orientation, percentage similarity and the distance between the copies can influence the susceptibility of LCRs to genomic rearrangement. In some embodiments, CNVs are referred to as structural variants. In some embodiments, structural variants can be a broader class of variant that can also include copy number neutral alterations such as inversions and balanced translocations.

CNVs can account for genetic variation affecting a substantial proportion of the human genome, for example, known CNVs can cover over 15% of the human genome sequence (Estivill, X Armengol; L., PLoS Genetics 3: 1787-99 (2007)). CNVs can affect gene expression, phenotypic variation and adaptation by disrupting gene dosage, and can cause disease, for example, microdeletion and microduplication disorders, and can confer susceptibility to diseases and disorders. Updated information about the location, type, and size of known CNVs can be found in one or more databases, for example, the Database of Genomic Variants (projects.tcag.ca/variation/), which currently contains data for over 66,000 CNVs (as of Nov. 2, 2010).

Other types of sequence variants can be found in the human genome and can be associated with a disease or disorder, including but not limited to, microsatellites. Microsatellite markers are stable, polymorphic, easily analyzed, and can occur regularly throughout the genome, making them especially suitable for genetic analysis. A polymorphic microsatellite can comprise multiple small repeats of bases, for example, CA repeats, at a particular site wherein the number of repeat lengths varies in a population. In some embodiments, microsatellites, for example, variable number of tandem repeats (VNTRs), can be short segments of DNA that have one or more repeated sequences, for example, about 2 to 5 nucleotides long, that can occur in non-coding DNA. In some embodiments, changes in microsatellites can occur during genetic recombination of sexual reproduction, increasing or decreasing the number of repeats found at an allele, or changing allele length.

Neurological Disorders

"Neurological disorders", as used herein, include Acquired Epileptiform Aphasia, Acute Disseminated Encephalomyelitis, Adrenoleukodystrophy, Agenesis of the corpus callosum, Agnosia, Aicardi syndrome, Alexander disease, Alpers' disease, Alternating hemiplegia, Alzheimer's disease, Amyotrophic lateral sclerosis (see Motor Neuron Disease), Anencephaly, Angelman syndrome, Angiomatosis, Anoxia, Aphasia, Apraxia, Arachnoid cysts, Arachnoiditis, Arnold-Chiari malformation, Arteriovenous malformation, Asperger's syndrome, Ataxia Telangiectasia, Attention Deficit Hyperactivity Disorder, Autism, Auditory processing disorder, Autonomic Dysfunction, Back Pain, Batten disease, Behcet's disease, Bell's palsy, Benign Essential Blepharospasm, Benign Focal Amyotrophy, Benign Intracranial Hypertension, Bilateral frontoparietal polymicrogyria, Binswanger's disease, Blepharospasm, Bloch-Sulzberger syndrome, Brachial plexus injury, Brain abscess, Brain damage, Brain injury, Brain tumor, Brown-Sequard syndrome, Canavan disease, Carpal tunnel syndrome (CTS), Causalgia, Central pain syndrome, Central pontine myelinolysis, Centronuclear myopathy, Cephalic disorder, Cerebral aneurysm, Cerebral arteriosclerosis, Cerebral atrophy, Cerebral gigantism, Cerebral palsy, Charcot-Marie-Tooth disease, Chiari malformation, Chorea, Chronic inflammatory demyelinating polyneuropathy (CIDP), Chronic pain, Chronic regional pain syndrome, Coffin Lowry syndrome, Coma, including Persistent Vegetative State, Congenital facial diplegia, Corticobasal degeneration, Cranial arteritis, Craniosynostosis, Creutzfeldt-Jakob disease, Cumulative trauma disorders, Cushing's syndrome, Cytomegalic inclusion body disease (CIBD), Cytomegalovirus Infection, Dandy-Walker syndrome, Dawson disease, De Morsier's syndrome, Dejerine-Klumpke palsy, Dejerine-Sottas disease, Delayed sleep phase syndrome, Dementia, Dermatomyositis, Neurological Dyspraxia, Diabetic neuropathy, Diffuse sclerosis, Dysautonomia, Dyscalculia, Dysgraphia, Dyslexia, Dystonia, Early infantile epileptic encephalopathy, Empty sella syndrome, Encephalitis, Encephalocele, Encephalotrigeminal angiomatosis, Encopresis, Epilepsy, Erb's palsy, Erythromelalgia, Essential tremor, Fabry's disease, Fahr's syndrome, Fainting, Familial spastic paralysis, Febrile seizures, Fisher syndrome, Friedreich's ataxia, FART Syndrome, Gaucher's disease, Gerstmann's syndrome, Giant cell arteritis, Giant cell inclusion disease, Globoid cell Leukodystrophy, Gray matter heterotopia, Guillain-Barre syndrome, HTLV-1 associated myelopathy, Hallervorden-Spatz disease, Head injury, Headache, Hemifacial Spasm, Hereditary Spastic Paraplegia, Heredopathia atactica polyneuritiformis, Herpes zoster oticus, Herpes zoster, Hirayama syndrome, Holoprosencephaly, Huntington's disease, Hydranencephaly, Hydrocephalus, Hypercortisolism, Hypoxia, Immune-Mediated encephalomyelitis, Inclusion body myositis, Incontinentia pigmenti, Infantile phytanic acid storage disease, Infantile Refsum disease, Infantile spasms, Inflammatory myopathy, Intracranial cyst, Intracranial hypertension, Joubert syndrome, Kearns-Sayre syndrome, Kennedy disease, Kinsbourne syndrome, Klippel Feil syndrome, Krabbe disease, Kugelberg-Welander disease, Kuru, Lafora disease, Lambert-Eaton myasthenic syndrome, Landau-Kleffner syndrome, Lateral medullary (Wallenberg) syndrome, Learning disabilities, Leigh's disease, Lennox-Gastaut syndrome, Lesch-Nyhan syndrome, Leukodystrophy, Lewy body dementia, Lissencephaly, Locked-In syndrome, Lou Gehrig's disease, Lumbar disc disease, Lyme disease—Neurological Sequelae, Machado-Joseph disease (Spinocerebellar ataxia type 3), Macrencephaly, Maple Syrup Urine Disease, Megalencephaly, Melkersson-Rosenthal syndrome, Menieres disease, Meningitis, Menkes disease, Metachromatic leukodystrophy, Microcephaly, Migraine, Miller Fisher syndrome, Mini-Strokes, Mitochondrial Myopathies, Mobius syndrome, Monomelic amyotrophy, Motor Neuron Disease, Motor skills disorder, Moyamoya disease, Mucopolysaccharidoses, Multi-Infarct Dementia, Multifocal motor neuropathy, Multiple sclerosis, Multiple system atrophy with postural hypotension, Muscular dystrophy, Myalgic encephalomyelitis, Myasthenia gravis, Myelinoclastic diffuse sclerosis, Myoclonic Encephalopathy of infants, Myoclonus, Myopathy, Myotubular myopathy, Myotonia congenita, Narcolepsy, Neurofibromatosis, Neuroleptic malignant syndrome, Neurological manifestations of AIDS, Neurological sequelae of lupus, Neuromyotonia, Neuronal ceroid lipofuscinosis, Neuronal migration disorders, Niemann-Pick disease, Non 24-hour sleep-wake syndrome, Nonverbal learning disorder, syndrome, Occipital Neuralgia, Occult Spinal Dysraphism Sequence, Ohtahara syndrome, Olivopontocerebellar atrophy, Opsoclonus myoclonus syndrome, Optic neuritis, Orthostatic Hypotension, Overuse syndrome, Palinopsia, Paresthesia, Parkinson's disease, Paramyotonia Congenita, Paraneoplastic diseases, Paroxysmal attacks, Parry-Romberg syndrome (also known as Rombergs Syndrome), Pelizaeus-Merzbacher disease, Periodic Paralyses, Peripheral neuropathy, Persistent Vegetative State, Pervasive neurological disorders, Photic sneeze reflex, Phytanic Acid Storage disease, Pick's disease, Pinched Nerve, Pituitary Tumors, PMG, Polio, Polymicrogyria, Polymyositis, Porencephaly, Post-Polio syndrome, Postherpetic Neuralgia (PHN), Postinfectious Encephalomyelitis, Postural Hypotension, Prader-Willi syndrome, Primary Lateral Sclerosis, Prion diseases, Progressive Hemifacial Atrophy also known as Rombergs_Syndrome, Progressive multifocal leukoencephalopathy, Progressive Sclerosing Poliodystrophy, Progressive Supranuclear Palsy, Pseudotumor cerebri, Ramsay-Hunt syndrome (Type I and Type II), Rasmussen's encephalitis, Reflex sympathetic dystrophy syndrome, Refsum disease, Repetitive motion disorders, Repetitive stress injury, Restless legs syndrome, Retrovirus-associated myelopathy, Rett syndrome, Reye's syndrome, Rombergs_Syndrome, Rabies, Saint Vitus dance, Sandhoff disease, Schytsophrenia, Schilder's disease, Schizencephaly, Sensory Integration Dysfunction, Septo-optic dysplasia, Shaken baby syndrome, Shingles, Shy-Drager syndrome, Sjogren's syndrome, Sleep apnea, Sleeping sickness, Snatiation, Sotos syndrome, Spasticity, Spina bifida, Spinal cord injury, Spinal cord tumors, Spinal muscular atrophy, Spinal stenosis, Steele-Richardson-Olszewski syndrome, see Progressive Supranuclear Palsy, Spinocerebellar ataxia, Stiff-person syndrome, Stroke, Sturge-Weber syndrome, Subacute sclerosing panencephalitis, Subcortical arteriosclerotic encephalopathy, Superficial siderosis, Sydenham's chorea, Syncope, Synesthesia, Syringomyelia, Tardive dyskinesia, Tay-Sachs disease, Temporal arteritis, Tethered spinal cord syndrome, Thomsen disease, Thoracic outlet syndrome, Tic Douloureux, Todd's paralysis, Tourette syndrome, Transient ischemic attack, Transmissible spongiform encephalopathies, Transverse myelitis, Traumatic brain injury, Tremor, Trigeminal neuralgia, Tropical spastic paraparesis, Trypanosomiasis, Tuberous sclerosis, Vasculitis including temporal arteritis, Von Hippel-Lindau disease (VHL), Viliuisk Encephalomyelitis (VE), Wallenberg's syndrome, Werdnig-Hoffman disease, West syndrome, Whiplash, Williams syndrome, Wilson's disease, X-Linked Spinal and Bulbar Muscular Atrophy, and Zellweger syndrome. In some embodiments, neurological conditions can comprise movement disorders. In a preferred embodiment, movement disorders comprise Parkinson's Disease (PD).

The term Parkinsonism is used for a motor syndrome whose main symptoms are tremor at rest, stiffness, slowing of movement and postural instability. Parkinsonian syndromes can be divided into four subtypes according to their origin: primary or idiopathic, secondary or acquired, hereditary parkinsonism, and parkinson plus syndromes or multiple system degeneration. Parkinson's disease is the most common form of Parkinsonism and is usually defined as "primary" Parkinsonism, meaning Parkinsonism with no external identifiable cause. As much as this can go against the definition of Parkinson's disease as an idiopathic illness, genetic Parkinsonism disorders with a similar clinical course to PD are generally included under the Parkinson's disease label. The terms "familial Parkinson's disease" and "sporadic Parkinson's disease" can be used to differentiate genetic from truly idiopathic forms of the disease.

PD is usually classified as a movement disorder, although it also gives rise to several non-motor types of symptoms such as sensory deficits, cognitive difficulties or sleep problems. Parkinson plus diseases are primary parkinsonisms which present additional features. They include multiple system atrophy, progressive supranuclear palsy, corticobasal degeneration and dementia with Lewy bodies.

In terms of pathophysiology, PD is considered a synucleinopathy due to an abnormal accumulation of alpha-synuclein polypeptide in the brain in the form of Lewy bodies, as opposed to other diseases such as Alzheimer's disease where the brain accumulates tau polypeptide in the form of neurofibrillary tangles. Nevertheless, there is clinical and pathological overlap between tauopathies and synucleinopathies. The most typical symptom of Alzheimer's disease, dementia, occurs in advanced stages of PD, while it is common to find neurofibrillary tangles in brains affected by PD.

Dementia with Lewy bodies (DLB) is another synucleinopathy that has similarities with PD, and especially with the subset of PD cases with dementia. However the relationship between PD and DLB is complex and still has to be clarified. They may represent parts of a continuum or they may be separate diseases.

Parkinson's disease affects movement, producing motor symptoms. Non-motor symptoms, which include autonomic dysfunction, neuropsychiatric problems (mood, cognition, behavior or thought alterations), and sensory and sleep difficulties, are also common.

Four motor symptoms are considered cardinal in PD: tremor, rigidity, slowness of movement, and postural instability. Tremor is the most apparent and well-known symptom. It is the most common; though around 30% of individuals with PD do not have tremor at disease onset, most develop it as the disease progresses. It is usually a rest tremor: maximal when the limb is at rest and disappearing with voluntary movement and sleep. It affects to a greater extent the most distal part of the limb and at onset typically appears in only a single arm or leg, becoming bilateral later. A feature of tremor is "pill-rolling", a term used to describe the tendency of the index finger of the hand to get into contact with the thumb and perform together a circular movement. The term derives from the similarity between the movement in PD patients and the earlier pharmaceutical technique of manually making pills.

Bradykinesia (slowness of movement) is another characteristic feature of PD, and is associated with difficulties along the whole course of the movement process, from planning to initiation and finally execution of a movement. Performance of sequential and simultaneous movement is hindered. Bradykinesia is the most disabling symptom in the early stages of the disease. Initial manifestations are problems when performing daily tasks which use fine motor control such as writing, sewing or getting dressed. Clinical evaluation is based on similar tasks such as alternating movements between both hands or both feet. Bradykinesia is not equal for all movements or times. It is modified by the activity or emotional state of the subject, to the point that some patients are barely able to walk yet can still ride a bicycle. Generally patients have less difficulty when some sort of external cue is provided.

Rigidity is stiffness and resistance to limb movement caused by increased muscle tone, an excessive and continuous contraction of muscles. In Parkinsonism the rigidity can be uniform (lead-pipe rigidity) or ratchety (cogwheel rigidity). The combination of tremor and increased tone is considered to be at the origin of cogwheel rigidity. Rigidity may be associated with joint pain; such pain being a frequent initial manifestation of the disease. In early stages of Parkinson's disease, rigidity is often asymmetrical and it tends to affect the neck and shoulder muscles prior to the muscles of the face and extremities. With the progression of the disease, rigidity typically affects the whole body and reduces the ability to move.

Postural instability is typical in the late stages of the disease, leading to impaired balance and frequent falls, and secondarily to bone fractures. Instability is often absent in the initial stages, especially in younger people. Up to 40% of the patients may experience falls and around 10% may have falls weekly, with number of falls being related to the severity of PD.

Other recognized motor signs and symptoms include gait and posture disturbances such as festination (rapid shuffling steps and a forward-flexed posture when walking), speech and swallowing disturbances including voice disorders, mask-like face expression or small handwriting, although the range of possible motor problems that can appear is large.

Parkinson's disease can cause neuropsychiatric disturbances which can range from mild to severe. This includes disorders of speech, cognition, mood, behavior, and thought. Cognitive disturbances can occur in the initial stages of the disease and sometimes prior to diagnosis, and increase in prevalence with duration of the disease. The most common cognitive deficit in affected individuals is executive dysfunction, which can include problems with planning, cognitive flexibility, abstract thinking, rule acquisition, initiating appropriate actions and inhibiting inappropriate actions, and selecting relevant sensory information. Fluctuations in attention and slowed cognitive speed are among other cognitive difficulties. Memory is affected, specifically in recalling learned information. Nevertheless, improvement appears when recall is aided by cues. Visuospatial difficulties are also part of the disease, seen for example, when the individual is asked to perform tests of facial recognition and perception of the orientation of drawn lines.

A person with PD has two to six times the risk of suffering dementia compared to the general population. The prevalence of dementia increases with duration of the disease. Dementia is associated with a reduced quality of life in people with PD and their caregivers, increased mortality, and a higher probability of needing nursing home care. Behavior and mood alterations are more common in PD without cognitive impairment than in the general population, and are usually present in PD with dementia. The most frequent mood difficulties are depression, apathy and anxiety. Impulse control behaviors such as medication overuse and craving, binge eating, hypersexuality, or pathological gambling can appear in PD and have been related to the medications used to manage the disease. Psychotic symptoms—hallucinations or delusions—occur in 4% of patients, and it is assumed that the main precipitant of psychotic phenomena in Parkinson's disease is dopaminergic excess secondary to treatment; it therefore becomes more common with increasing age and levodopa intake.

In addition to cognitive and motor symptoms, PD can impair other body functions. Sleep problems are a feature of the disease and can be worsened by medications. Symptoms can manifest in daytime drowsiness, disturbances in REM sleep, or insomnia. Alterations in the autonomic nervous system can lead to orthostatic hypotension (low blood pressure upon standing), oily skin and excessive sweating, urinary incontinence and altered sexual function. Constipation and gastric dysmotility can be severe enough to cause discomfort and even endanger health. PD is related to several eye and vision abnormalities such as decreased blink rate, dry eyes, deficient ocular pursuit (eye tracking) and saccadic movements (fast automatic movements of both eyes in the same direction), difficulties in directing gaze upward, and blurred or double vision. Changes in perception may include an impaired sense of smell, sensation of pain and paresthesia (skin tingling and numbness). All of these symptoms can occur years before diagnosis of the disease.

The primary symptoms of Parkinson's disease result from greatly reduced activity of dopamine-secreting cells caused by cell death in the pars compacta region of the substantia nigra. There are five major pathways in the brain connecting other brain areas with the basal ganglia. These are known as the motor, oculo-motor, associative, limbic and orbitofrontal circuits, with names indicating the main projection area of each circuit. All of them are affected in PD, and their disruption explains many of the symptoms of the disease since these circuits are involved in a wide variety of functions including movement, attention and learning.

Most people with Parkinson's disease have idiopathic Parkinson's disease (having no specific known cause). A small proportion of cases, however, can be attributed to known genetic factors. Mutations in specific genes have been conclusively shown to cause PD. These genes code for alpha-synuclein (SNCA, also known as PARK1 and PARK4), parkinson protein 2 (PARK2, but also known as parkin, PRKN, as well as E3 ubiquitin ligase), leucine-rich repeat kinase 2 (LRRK2, also known as dardarin), PTEN-induced putative kinase 1 (P1NK1, also known as PARK6), parkinson protein 7 (PARK7, also known as DJ-1) and ATPase type 13A2 (ATP13A2), in which some mutations are referred to as Kufor-Rakeb syndrome. In most cases, people with these mutations can develop PD. With the exception of LRRK2, however, they account for only a small minority of cases of PD. The most extensively studied PD-related genes are SNCA and LRRK2. Mutations in genes including SNCA, LRRK2 and glucocerebrosidase (GBA) have been found to be risk factors for sporadic PD. Mutations in GBA are known to cause Gaucher's disease.

Subjects

PD invariably progresses with time. The Hoehn and Yahr scale, which defines five stages of progression, is commonly used to estimate the progress of the disease. Motor symptoms, if not treated, advance aggressively in the early stages of the disease and more slowly later. Untreated, subjects are expected to lose independent ambulation after an average of eight years and be bedridden after ten years. However, it is uncommon to find untreated subjects nowadays. Medication has improved the prognosis of motor symptoms, while at the same time it is a new source of disability because of the undesired effects of levodopa after years of use. In subjects taking levodopa, the progression time of symptoms to a stage of high dependency from caregivers may be over 15 years. However, it is hard to predict what course the disease can take for a given subject. Age is the best predictor of disease progression. The rate of motor decline is greater in those with less impairment at the time of diagnosis, while cognitive impairment is more frequent in those who are over 70 years of age at symptom onset.

Since current therapies improve motor symptoms, disability at present is mainly related to non-motor features of the disease. Nevertheless, the relationship between disease progression and disability is not linear. Disability is initially related to motor symptoms. As the disease advances, disability is more related to motor symptoms that do not respond adequately to medication, such as swallowing/speech difficulties, and gait/balance problems; and also to motor complications, which appear in up to 50% of subjects after 5 years of levodopa usage. Finally, after ten years most subjects with the disease have autonomic disturbances, sleep problems, mood alterations and cognitive decline. All of these symptoms, especially cognitive decline, greatly increase disability.

A "subject," as used herein, can be an individual of any age or sex from whom a nucleic acid sample containing nucleotides is obtained for analysis by one or more methods described herein so as to obtain nucleic acid information, for example, a male or female adult, child, newborn, or fetus. In some embodiments, a subject can be any target of therapeutic administration. In some embodiments, a subject can be a test subject or a reference subject. In some embodiments, a subject can be associated with a condition or disease or disorder, asymptomatic or symptomatic, have increased or decreased susceptibility to a disease or disorder, be associated or unassociated with a treatment or treatment regimen, or any combination thereof. As used in the present disclosure a cohort can represent an ethnic group, a patient group, a particular age group, a group not associated with a particular disease or disorder, a group associated with a particular disease or disorder, a group of asymptomatic subjects, a group of symptomatic subjects, or a group or subgroup of subjects associated with a particular response to a treatment regimen or clinical trial. In some embodiments, a patient can be a subject afflicted with a disease or disorder. In some embodiments, a patient can be a subject not afflicted with a disease or disorder. In some embodiments, a subject can be a test subject, a patient or a candidate for a therapeutic, wherein genomic DNA from the subject, patient, or candidate is obtained for analysis by one or more methods of the present disclosure herein, so as to obtain genetic variation information of the subject, patient or candidate.

In some embodiments, the nucleic acid sample can be obtained prenatally from a fetus or embryo or from the mother, for example, from fetal or embryonic cells in the maternal circulation. In some embodiments, the nucleic acid sample can be obtained with the assistance of a health care provider, for example, to draw blood. In some embodiments, the nucleic acid sample can be obtained without the assistance of a health care provider, for example, where the nucleic acid sample is obtained non-invasively, such as a saliva sample, or a sample comprising buccal cells that is obtained using a buccal swab or brush, or a mouthwash sample.

The present disclosure also provides methods for assessing genetic variations in subjects who are members of a target population. Such a target population is in some embodiments a population or group of subjects at risk of developing the disease, based on, for example, other genetic factors, biomarkers, biophysical parameters, family history of a neurological disorder, previous screening or medical history, or any combination thereof.

Although PD is known to affect older adults more frequently than children, subjects of all ages are contemplated in the present disclosure. In some embodiments subjects can be from specific age subgroups, such as those over the age of 1, over the age of 2, over the age of 3, over the age of 4, over the age of 5, over the age of 6, over the age of 7, over the age of 8, over the age of 9, over the age of 10, over the age of 15, over the age of 20, over the age of 25, over the age of 30, over the age of 35, over the age of 40, over the age of 45, over the age of 50, over the age of 55, over the age of 60, over the age of 65, over the age of 70, over the age of 75, over the age of 80, or over the age of 85. Other embodiments of the disclosure pertain to other age groups, such as subjects aged less than 85, such as less than age 80, less than age 75, less than age 70, less than age 65, less than age 60, less than age 55, less than age 50, less than age 45, less than age 40, less than age 35, less than age 30, less than age 25, less than age 20, less than age 15, less than age 10, less than age 9, less than age 8, less than age 6, less than age 5, less than age 4, less than age 3, less than age 2, or less than age 1. Other embodiments relate to subjects with age at onset of the disease in any of particular age or age ranges defined by the numerical values described in the above or other numerical values bridging these numbers. It is also contemplated that a range of ages can be relevant in certain embodiments, such as age at onset at more than age 15 but less than age 20. Other age ranges are however also contemplated, including all age ranges bracketed by the age values listed in the above.

The genetic variations of the present disclosure found to be associated with a neurological disorder can show similar association in other human populations. Particular embodiments comprising subject human populations are thus also contemplated and within the scope of the disclosure. Such embodiments relate to human subjects that are from one or more human populations including, but not limited to, Caucasian, European, American, Eurasian, Asian, Central/South Asian, East Asian, Middle Eastern, African, Hispanic, and Oceanic populations. European populations include, but are not limited to, Swedish, Norwegian, Finnish, Russian, Danish, Icelandic, Irish, Kelt, English, Scottish, Dutch, Belgian, French, German, Spanish, Portuguese, Italian, Polish, Bulgarian, Slavic, Serbian, Bosnian, Czech, Greek and Turkish populations. The racial contribution in subject subjects can also be determined by genetic analysis, for example, genetic analysis of ancestry can be carried out using unlinked microsatellite markers such as those set out in Smith et al. (Am J Hum Genet. 74, 1001-13 (2004))

It is also well known to the person skilled in the art that certain genetic variations have different population frequencies in different populations, or are polymorphic in one population but not in another. A person skilled in the art can however apply the methods available and as thought herein to practice the present disclosure in any given human population. This can include assessment of genetic variations of the present disclosure, so as to identify those markers that give strongest association within the specific population. Thus, the at-risk variants of the present disclosure can reside on different haplotype background and in different frequencies in various human populations.

Samples

Samples that are suitable for use in the methods described herein can be nucleic acid samples from a subject. A "nucleic acid sample" as used herein can include RNA, DNA, polypeptides, or a combination thereof. Nucleic acids and polypeptides can be extracted from one or more nucleic acid samples including but not limited to, blood, saliva, urine, mucosal scrapings of the lining of the mouth, expectorant, serum, tears, skin, tissue, or hair. A nucleic acid sample can be assayed for nucleic acid information. "Nucleic acid information," as used herein, includes a nucleic acid sequence itself, the presence/absence of genetic variation in the nucleic acid sequence, a physical property which varies depending on the nucleic acid sequence (for example, Tm), and the amount of the nucleic acid (for example, number of mRNA copies). A "nucleic acid" means any one of DNA, RNA, DNA including artificial nucleotides, or RNA including artificial nucleotides. As used herein, a "purified nucleic acid" includes cDNAs, fragments of genomic nucleic acids, nucleic acids produced polymerase chain reaction (PCR), nucleic acids formed by restriction enzyme treatment of genomic nucleic acids, recombinant nucleic acids, and chemically synthesized nucleic acid molecules. A "recombinant" nucleic acid molecule includes a nucleic acid molecule made by an artificial combination of two otherwise separated segments of sequence, e.g., by chemical synthesis or by the manipulation of isolated segments of nucleic acids by genetic engineering techniques. As used herein, a "polypeptide" includes proteins, fragments of proteins, and peptides, whether isolated from natural sources, produced by recombinant techniques, or chemically synthesized. A polypeptide may have one or more modifications, such as a post-translational modification (e.g., glycosylation, etc.) or any other modification (e.g., pegylation, etc.). The polypeptide may contain one or more non-naturally-occurring amino acids (e.g., such as an amino acid with a side chain modification).

In some embodiments, the nucleic acid sample can comprise cells or tissue, for example, cell lines. Exemplary cell types from which nucleic acids can be obtained using the methods described herein and include but are not limited to, a blood cell; such as a B lymphocyte, T lymphocyte, leukocyte, erythrocyte, macrophage, or neutrophil; a muscle cell such as a skeletal cell, smooth muscle cell or cardiac muscle cell; a germ cell, such as a sperm or egg; an epithelial cell; a connective tissue cell, such as an adipocyte, chondrocyte; fibroblast or osteoblast; a neuron; an astrocyte; a stromal cell; an organ specific cell, such as a kidney cell, pancreatic cell, liver cell, or a keratinocyte; a stem cell; or any cell that develops there from. A cell from which nucleic acids can be obtained can be at a particular neurological level including, for example, a hematopoietic stem cell or a cell that arises from a hematopoietic stem cell such as a red blood cell, B lymphocyte, T lymphocyte, natural killer cell, neutrophil, basophil, eosinophil, monocyte, macrophage, or platelet. Generally any type of stem cell can be used including, without limitation, an embryonic stem cell, adult stem cell, or pluripotent stem cell.

In some embodiments, a nucleic acid sample can be processed for RNA or DNA isolation, for example, RNA or DNA in a cell or tissue sample can be separated from other components of the nucleic acid sample. Cells can be harvested from a nucleic acid sample using standard techniques known in the art, for example, by centrifuging a cell sample and resuspending the pelleted cells, for example, in a buffered solution, for example, phosphate-buffered saline (PBS). In some embodiments, after centrifuging the cell suspension to obtain a cell pellet, the cells can be lysed to extract DNA. In some embodiments, the nucleic acid sample can be concentrated and/or purified to isolate DNA. All nucleic acid samples obtained from a subject, including those subjected to any sort of further processing, are considered to be obtained from the subject. In some embodiments, standard techniques and kits known in the art can be used to extract RNA or DNA from a nucleic acid sample, including, for example, phenol extraction, a QIAamp® Tissue Kit (Qiagen, Chatsworth, Calif.), a Wizard® Genomic DNA purification kit (Promega), or a Qiagen Autopure method using Puregene chemistry, which can enable purification of highly stable DNA well-suited for archiving.

In some embodiments, determining the identity of an allele or determining copy number can, but need not, include obtaining a nucleic acid sample comprising RNA and/or DNA from a subject, and/or assessing the identity, copy number, presence or absence of one or more genetic variations and their chromosomal locations in the nucleic acid sample. The individual or organization that performs the determination need not actually carry out the physical analysis of a nucleic acid sample from a subject. In some embodiments, the methods can include using information obtained by analysis of the nucleic acid sample by a third party. In some embodiments, the methods can include steps that occur at more than one site. For example, a nucleic acid sample can be obtained from a subject at a first site, such as at a health care provider or at the subject's home in the case of a self-testing kit. The nucleic acid sample can be analyzed at the same or a second site, for example, at a laboratory or other testing facility.

Methods of Screening

As used herein, "screening" a subject includes diagnosing, theranosing, or determining the susceptibility to developing (prognosing) a neurological disorder, for example, PD. In particular embodiments, the disclosure is a method of determining a presence of, or a susceptibility to, a neurological disorder, by detecting at least one genetic variation in a nucleic acid sample from a subject as described herein. In some embodiments, detection of particular alleles, markers, variations, or haplotypes is indicative of a presence or susceptibility to a neurological disorder.

A physician can diagnose Parkinson's disease from the medical history and a neurological examination. There is no lab test that can clearly identify the disease, but brain scans are sometimes used to rule out disorders that could give rise to similar symptoms. Patients may be given levodopa (L-DOPA) and resulting relief of motor impairment tends to confirm diagnosis. The finding of Lewy bodies in the midbrain on autopsy is usually considered proof that the patient suffered from Parkinson's disease. The progress of the illness over time may reveal it is not Parkinson's disease, and some authorities recommend that the diagnosis be periodically reviewed.

Other causes that can secondarily produce a parkinsonian syndrome are Alzheimer's disease, multiple cerebral infarction and drug-induced Parkinsonism. Parkinson plus syndromes such as progressive supranuclear palsy and multiple system atrophy should be ruled out. Anti-Parkinson's medications are typically less effective at controlling symptoms in Parkinson plus syndromes. Faster progression rates, early cognitive dysfunction or postural instability, minimal tremor or symmetry at onset may indicate a Parkinson plus disease rather than PD itself. Genetic forms are usually classified as PD, although the terms familial Parkinson's disease and familial Parkinsonism are used for disease entities with an autosomal dominant or recessive pattern of inheritance.

Medical organizations have created diagnostic criteria to ease and standardize the diagnostic process, especially in the early stages of the disease. The most widely known criteria come from the UK Parkinson's Disease Society Brain Bank and the US National Institute of Neurological Disorders and Stroke. The PD Society Brain Bank criteria require slowness of movement (bradykinesia) plus either rigidity, resting tremor, or postural instability. Other possible causes for these symptoms need to be ruled out. Finally, three or more of the following features are required during onset or evolution: unilateral onset, tremor at rest, progression in time, asymmetry of motor symptoms, response to levodopa for at least five years, clinical course of at least ten years, and appearance of dyskinesias induced by the intake of excessive levodopa. Accuracy of diagnostic criteria evaluated at autopsy is 75-90%, with specialists such as neurologists having the highest rates.

Computed tomography (CT) and magnetic resonance imaging (MRI) brain scans of people with PD usually appear normal. These techniques are nevertheless useful to rule out other diseases that can be secondary causes of parkinsonism, such as basal ganglia tumors, vascular pathology and hydrocephalus. A specific technique of MRI, diffusion MRI, has been reported to be useful at discriminating between typical and atypical parkinsonism, although its exact diagnostic value is still under investigation. Dopaminergic function in the basal ganglia can be measured with different PET and SPECT radiotracers. Examples are ioflupane (123I) (trade name DaTSCAN) and iometopane (Dopascan) for SPECT or fludeoxyglucose (18F) for PET. A pattern of reduced dopaminergic activity in the basal ganglia can aid in diagnosing PD.

Within any given population, there can be an absolute susceptibility of developing a disease or trait, defined as the chance of a person developing the specific disease or trait over a specified time-period. Susceptibility (e.g. being at-risk) is typically measured by looking at very large numbers of people, rather than at a particular individual. As described herein, certain copy number variations (genetic variations) are found to be useful for susceptibility assessment of a neurological disorder. Susceptibility assessment can involve detecting particular genetic variations in the genome of individuals undergoing assessment. Particular genetic variations are found more frequently in individuals with a neurological disorder, than in individuals without screening of a neurological disorder. Therefore, these genetic variations have predictive value for detecting a neurological disorder, or a susceptibility to a neurological disorder, in an individual. Without intending to be limited by theory, it is believed that the genetic variations described herein to be associated with susceptibility of a neurological disorder represent functional variants predisposing to the disease. In some embodiments, a genetic variation can confer a susceptibility of the condition, for example, carriers of the genetic variation are at a different risk of the condition than non-carriers. In a preferred embodiment, the presence of a genetic variation is indicative of increased susceptibility to a neurological disorder, such as Parkinson's disease.

In some embodiments, screening can be performed using any of the methods disclosed, alone or in combination. In some embodiments, screening can be performed using Polymerase Chain Reaction (PCR). In a preferred embodiment screening can be performed using Array Comparative Genomic Hybridization (aCGH). In some embodiments, the genetic variation information as it relates to the current disclosure can be used in conjunction with any of the above mentioned symptomatic screening tests to screen a subject for PD, for example, using a combination of aCGH and different PET radiotracers.

In some embodiments, information from any of the above screening methods (e.g. specific symptoms, scoring matrix, or genetic variation data) can be used to define a subject as a test subject or reference subject. In some embodiments, information from any of the above screening methods can be used to associate a subject with a test or reference population, for example, a subject in a population.

In one embodiment, an association with a neurological disorder can determined by the statistical likelihood of the presence of a genetic variation in a subject with a neurological disorder, for example, an unrelated individual or a first or second-degree relation of the subject. In some embodiments, an association with a neurological disorder can be determined by determining the statistical likelihood of the absence of a genetic variation in an unaffected reference subject, for example, an unrelated individual or a first or second-degree relation of the subject. The methods described herein can include obtaining and analyzing a nucleic acid sample from one or more suitable reference subjects.

In the present context, the term screening comprises diagnosis, prognosis, and theranosis. Screening can refer to any available screening method, including those mentioned herein. As used herein, susceptibility can be proneness of a subject towards the development of a neurological condition, or towards being less able to resist a particular neurological condition than one or more control subjects. In some embodiments, susceptibility can encompass increased susceptibility. For example, particular nucleic acid variations of the disclosure as described herein can be characteristic of increased susceptibility to development of a neurological disorder. In some embodiments, susceptibility can encompass decreased susceptibility, for example, particular nucleic variations of the disclosure as described herein can be characteristic of decreased susceptibility to development of a neurological disorder.

As described herein, a genetic variation predictive of susceptibility to or presence of a neurological disorder can be one where the particular genetic variation is more frequently present in a subject with the condition (affected), compared to the frequency of its presence in a reference group (control), such that the presence of the genetic variation is indicative of susceptibility to or presence of the neurological disorder. In some embodiments, the reference group can be a population nucleic acid sample, for example, a random nucleic acid sample from the general population or a mixture of two or more nucleic acid samples from a population. In some embodiments, disease-free controls can be characterized by the absence of one or more specific disease-associated symptoms, for example, individuals who have not experienced symptoms associated with a neurological disorder. In some embodiments, the disease-free control group is characterized by the absence of one or more disease-specific risk factors, for example, at least one genetic and/or environmental risk factor. In some embodiments, a reference sequence can be referred to for a particular site of genetic variation. In some embodiments, a reference allele can be a wild-type allele and can be chosen as either the first sequenced allele or as the allele from a control individual. In some embodiments, one or more reference subjects can be characteristically matched with one or more affected subjects, for example, with matched aged, gender or ethnicity.

A person skilled in the art can appreciate that for genetic variations with two or more alleles present in the population being studied, and wherein one allele can found in increased frequency in a group of individuals with a neurological disorder in the population, compared with controls, the other allele of the marker can be found in decreased frequency in the group of individuals with the trait or disease, compared with controls. In such a case, one allele of the marker, for example, the allele found in increased frequency in individuals with a neurological disorder, can be the at-risk allele, while the other allele(s) can be a neutral or protective allele.

A genetic variant associated with a neurological disorder can be used to predict the susceptibility of the disease for a given genotype. For any genetic variation, there can be one or more possible genotypes, for example, homozygote for the at-risk variant (e.g., in autosomal recessive disorders), heterozygote, and non-carrier of the at-risk variant. In some embodiments, susceptibility associated with variants at multiple loci can be used to estimate overall susceptibility. For multiple genetic variants, there can be k ($k=3^n*2^P$) possible genotypes; wherein n can be the number of autosomal loci and p can be the number of gonosomal (sex chromosomal) loci. Overall susceptibility assessment calculations can assume that the relative susceptibilities of different genetic variants multiply, for example, the overall susceptibility associated with a particular genotype combination can be the product of the susceptibility values for the genotype at each locus. If the susceptibility presented is the relative susceptibility for a person, or a specific genotype for a person, compared to a reference population, then the combined susceptibility can be the product of the locus specific susceptibility values and can correspond to an overall susceptibility estimate compared with a population. If the susceptibility for a person is based on a comparison to non-carriers of the at-risk allele, then the combined susceptibility can correspond to an estimate that compares the person with a given combination of genotypes at all loci to a group of individuals who do not carry at-risk variants at any of those loci. The group of non-carriers of any at-risk variant can have the lowest estimated susceptibility and can have a combined susceptibility, compared with itself, for example, non-carriers, of 1.0, but can have an overall susceptibility, compared with the population, of less than 1.0.

Overall risk for multiple risk variants can be performed using standard methodology. Genetic variations described herein can form the basis of risk analysis that combines other genetic variations known to increase risk of a neurological disorder, or other genetic risk variants for a neurological disorder. In certain embodiments of the disclosure, a plurality of variants (genetic variations, variant alleles, and/or haplotypes) can be used for overall risk assessment. These variants are in some embodiments selected from the genetic variations as disclosed herein. Other embodiments include the use of the variants of the present disclosure in combination with other variants known to be useful for screening a susceptibility to a neurological disorder. In such embodiments, the genotype status of a plurality of genetic variations, markers and/or haplotypes is determined in an individual, and the status of the individual compared with the population frequency of the associated variants, or the frequency of the variants in clinically healthy subjects, such as age-matched and sex-matched subjects.

Methods known in the art, such as the use of available algorithms and software can be used to identify, or call, significant genetic variations, including but not limited to, algorithms of DNA Analytics or DNAcopy, iPattern and/or QuantiSNP. In some embodiments, a threshold log ratio value can be used to determine losses and gains. For example, using DNA Analytics, a log 2 ratio cutoff of 0.25 and −0.25 to classify CNV gains and losses respectively can be used. As a further example, using DNAcopy, a log 2 ratio cutoff of 0.35 and −0.35 to classify CNV gains and losses respectively can be used. For example, an Aberration Detection Module 2 (ADM2) algorithm, such as that of DNA Analytics 4.0.85 can be used to identify, or call, significant genetic variations. In some embodiments, two or more algorithms can be used to identify, or call, significant genetic variations. For example, 2, 3, 4, 5, 6, 7, 8, 9, or 10 or more algorithms can be used to identify, or call, significant genetic variations. In some embodiments, significant genetic variations can be CNVs.

CNVs detected by 2 or more algorithms can be defined as stringent and can be utilized for further analyses. In some embodiments, the information and calls from two or more of the methods described herein can be compared to each other to identify significant genetic variations more or less stringently. For example, CNV calls generated by two or more of DNA Analytics, Aberration Detection Module 2 (ADM2) algorithms, and DNAcopy algorithms can be defined as stringent CNVs. In some embodiments significant or stringent genetic variations can be tagged as identified or called if it can be found to have a minimal reciprocal overlap to a genetic variation detected by one or more platforms and/or methods described herein. For example, a minimum of 50% reciprocal overlap can be used to tag the CNVs as identified or called. For example, significant or stringent genetic variations can be tagged as identified or called if it can be found to have a reciprocal overlap of more than about 50%, 55% 60%, 65%, 70%, 75%, 80%, 85%, 90%, or 95%, 99%, or equal to 100%, to a genetic variation detected by one or more platforms and/or methods described herein. For example, significant or stringent genetic variations can be tagged as identified or called if it can be found to have a reciprocal overlap of more than about 50% reciprocal overlap to a genetic variation detected by one or more platforms and/or methods described herein.

In some embodiments, a threshold log ratio value can be used to determine losses and gains. A log ratio value can be any log ratio value; for example, a log ratio value can be a log 2 ratio or a log 10 ratio. In some embodiments, a CNV segment whose median log 2 ratio is less than or equal to a log 2 ratio threshold value can be classified as a loss. For example, any segment whose median log 2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, can be classified as a loss.

In some embodiments, one algorithm can be used to call or identify significant genetic variations, wherein any segment whose median log 2 ratio was less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, can be classified as a loss. For example, any CNV segment whose median log 2 ratio is less than −0.35 as determined by DNAcopy can be classified as a loss. For example, losses can be determined according to a threshold log 2 ratio, which can be set at −0.35.

In some embodiments, two algorithms can be used to call or identify significant genetic variations, wherein any segment whose median log 2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, as determined by one algorithm, and wherein any segment whose median log 2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20, or less, as determined by the other algorithm can be classified as a loss. For example, CNV calling can comprise using the Aberration Detection Module 2 (ADM2) algorithm and the DNAcopy algorithm, wherein losses can be determined according to a two threshold log 2 ratios, wherein the Aberration Detection Module 2 (ADM2) algorithm log 2 ratio can be −0.25 and the DNAcopy algorithm log 2 ratio can be −0.41.

In some embodiments, the use of two algorithms to call or identify significant genetic variations can be a stringent method. In some embodiments, the use of two algorithms to call or identify significant genetic variations can be a more stringent method compared to the use of one algorithm to call or identify significant genetic variations.

In some embodiments, any CNV segment whose median log 2 ratio is greater than a log 2 ratio threshold value can be classified as a gain. For example, any segment whose median log 2 ratio is greater than 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more can be classified as a gain.

In some embodiments, one algorithm can be used to call or identify significant genetic variations, wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more can be classified as a gain. For example, any CNV segment whose median log 2 ratio is greater than 0.35 as determined by DNAcopy can be classified as a gain. For example, gains can be determined according to a threshold log 2 ratio, which can be set at 0.35.

In some embodiments, two algorithms can be used to call or identify significant genetic variations, wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, or 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3 or more, as determined by one algorithm, and wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, or 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more, as determined by the other algorithm the can be classified as a gain. For example, CNV calling can comprise using the Aberration Detection Module 2 (ADM2) algorithm and the DNAcopy algorithm, wherein gains can be determined according to a two threshold log 2 ratios, wherein the Aberration Detection Module 2 (ADM2) algorithm log 2 ratio can be 0.25 and the DNAcopy algorithm log 2 ratio can be 0.32.

Any CNV segment whose absolute (median log-ratio/mad) value is less than 2 can be excluded (not identified as a significant genetic variation). For example, any CNV segment whose absolute (median log-ratio/mad) value is less than 2, 1.9, 1.8, 1.7, 1.6, 1.5, 1.4, 1.3, 1.2, 1.1, 1, 0.9, 0.8, 0.7, 0.6, or 0.5 or less can be excluded.

In some embodiments, multivariate analyses or joint risk analyses, including the use of multiplicative model for overall risk assessment, and can subsequently be used to determine the overall risk conferred based on the genotype status at the multiple loci. Use of a multiplicative model, for example, assuming that the risk of individual risk variants multiply to establish the overall effect, allows for a straightforward calculation of the overall risk for multiple markers. The multiplicative model is a parsimonious model that usually fits the data of complex traits reasonably well. Deviations from multiplicity have been rarely described in the context of common variants for common diseases, and if reported are usually only suggestive since very large sample sizes can be required to be able to demonstrate statistical interactions between loci. Assessment of risk based on such analysis can subsequently be used in the methods, uses and kits of the disclosure, as described herein.

In some embodiments, the significance of increased or decreased susceptibility can be measured by a percentage. In some embodiments, a significant increased susceptibility can be measured as a relative susceptibility of at least 1.2, including but not limited to: at least 1.5, at least 1.3, at least 1.4, at least 1.5, at least 1.6, at least 1.7, 1.8, at least 1.9, at least 2.0, at least 2.5, at least 3.0, at least 4.0, at least 5.0, at least 6.0, at least 7.0, at least 8.0, at least 9.0, at least 10.0, and at least 15.0. In some embodiments, a relative susceptibility of at least 2.0, at least 3.0, at least 4.0, at least, 5.0, at least 6.0, or at least 10.0 is significant. Other values for significant susceptibility are also contemplated, for example, at least 2.5, 3.5, 4.5, 5.5, or any suitable other numerical values, wherein the values are also within scope of the present disclosure. In some embodiments, a significant increase in susceptibility is at least about 20%, including but not limited to about 25%, 30%, 35%, 40%, 45%, 50%, 55%, 60%, 65%, 70%, 75%, 80%, 85%, 90%, 95%, 100%, 150%, 200%, 300%, 400%, 500%, 600%, 700%, 800%, 900%, 1000%, and 1500%. In one particular embodiment, a significant increase in susceptibility is at least 100%. In other embodiments, a significant increase in susceptibility is at least 200%, at least 300%, at least 400%, at least 500%, at least 700%, at least 800%, at least 900% and at least 1000%. Other cutoffs or ranges as deemed suitable by the person skilled in the art to characterize the disclosure are also contemplated, and those are also within scope of the present disclosure. In certain embodiments, a significant increase in susceptibility is characterized by a p-value, such as a p-value of less than 0.5, less than 0.4, less than 0.3, less than 0.2, less than 0.1, less than 0.05, less than 0.01, less than 0.001, less than 0.0001, less than 0.00001, less than 0.000001, less than 0.0000001, less than 0.00000001, or less than 0.000000001.

In some embodiments, an individual who is at a decreased susceptibility for or the lack of presence of a neurological condition can be an individual in whom at least one genetic variation, conferring decreased susceptibility for or the lack of presence of the neurological disorder is identified. In some embodiments, the genetic variations conferring decreased susceptibility are also protective. In one aspect, the genetic variations can confer a significant decreased susceptibility of or lack of presence of the neurological disorder.

In some embodiments, significant decreased susceptibility can be measured as a relative susceptibility of less than 0.9, including but not limited to less than 0.9, less than 0.8, less than 0.7, less than 0.6, less than 0.5, less than 0.4, less than 0.3, less than 0.2 and less than 0.1. In some embodiments, the decrease in susceptibility is at least 20%, including but not limited to at least 25%, at least 30%, at least 35%, at least 40%, at least 45%, at least 50%, at least 55%, at least 60%, at least 65%, at least 70%, at least 75%, at least 80%, at least 85%, at least 90%, at least 95% and at least 98%. Other cutoffs or ranges as deemed suitable by the person, skilled in the art to characterize the disclosure are however also contemplated, and those are also within scope of the present disclosure. In certain embodiments, a significant decrease in susceptibility is characterized by a p-value, such as a p-value of less than 0.05, less than 0.01, less than 0.001, less than 0.0001, less than 0.00001, less than 0.000001, less than 0.0000001, less than 0.00000001, or less than 0.000000001. Other tests for significance can be used, for example, a Fisher-exact test. Other statistical tests of significance known to the skilled person are also contemplated and are also within scope of the disclosure.

In some preferred embodiments, the significance of increased or decreased susceptibility can be determined according to the ratio of measurements from a test subject to a reference subject. In a preferred embodiment, losses or gains of one or more CNVs can be determined according to a threshold $\log_2$ ratio determined by these measurements. In some embodiments, a $\log_2$ ratio value greater than 0.35 is indicative of a gain of one or more CNVs. In some embodiments, a $\log_2$ ratio value less than −0.35 is indicative of a loss of one or more CNVs. In some embodiments, the ratio of measurements from a test subject to a reference subject may be inverted such that the log 2 ratios of copy number gains are negative and the log 2 ratios of copy number losses are positive.

In some embodiments, the combined or overall susceptibility associated with a plurality of variants associated with a neurological disorder can also be assessed; for example, the genetic variations described herein to be associated with susceptibility to a neurological disorder can be combined with other common genetic risk factors. Combined risk for such genetic variants can be estimated in an analogous fashion to the methods described herein.

Calculating risk conferred by a particular genotype for the individual can be based on comparing the genotype of the individual to previously determined risk expressed, for example, as a relative risk (RR) or an odds ratio (OR), for the genotype, for example, for a heterozygous carrier of an at-risk variant for a neurological disorder. An odds ratio can be a statistical measure used as a metric of causality. For example, in genetic disease research it can be used to convey the significance of a variant in a disease cohort relative to an unaffected/normal cohort. The calculated risk for the individual can be the relative risk for a subject, or for a specific genotype of a subject, compared to the average population. The average population risk can be expressed as a weighted average of the risks of different genotypes, using results from a reference population, and the appropriate calculations to calculate the risk of a genotype group relative to the population can then be performed. Alternatively, the risk for an individual can be based on a comparison of particular genotypes, for example, heterozygous carriers of an at-risk allele of a marker compared with non-carriers of the at-risk allele. Using the population average can, in certain embodiments, be more convenient, since it provides a measure which can be easy to interpret for the user, such as, a measure that gives the risk for the individual, based on his/her genotype, compared with the average in the population.

In certain embodiments of the disclosure, a genetic variation is correlated to a neurological disorder by referencing genetic variation data to a look-up table that comprises correlations between the genetic variation and a neurological disorder. The genetic variation in certain embodiments comprises at least one indication of the genetic variation. In some embodiments, the table comprises a correlation for one genetic variation. In other embodiments, the table comprises a correlation for a plurality of genetic variations In both scenarios, by referencing to a look-up table that gives an indication of a correlation between a genetic variation and a neurological disorder, a risk for a neurological disorder, or a susceptibility to a neurological disorder, can be identified in the individual from whom the nucleic acid sample is derived.

The present disclosure also pertains to methods of clinical screening, for example, diagnosis, prognosis, or theranosis of a subject performed by a medical professional using the methods disclosed herein. In other embodiments, the disclosure pertains to methods of screening performed by a layman. The layman can be a customer of a genotyping service. The layman can also be a genotype service provider, who performs genotype analysis on a nucleic acid sample from an individual, in order to provide service related to genetic risk factors for particular traits or diseases, based on the genotype status of the subject obtained from use of the methods described herein. The resulting genotype information can be made available to the individual and can be compared to information about neurological disorder or risk of developing a neurological disorder associated with various genetic variations, including but not limited to, information from public literature and scientific publications. The screening applications of neurological disorder-associated genetic variations, as described herein, can, for example, be performed by an individual, a health professional, or a third party, for example, a service provider who interprets genotype information from the subject.

The information derived from analyzing sequence data can be communicated to any particular body, including the individual from which the nucleic acid sample or sequence data is derived, a guardian or representative of the individual, clinician, research professional, medical professional, service provider, and medical insurer or insurance company. Medical professionals can be, for example, doctors, nurses, medical laboratory technologists, and pharmacists. Research professionals can be, for example, principle investigators, research technicians, postdoctoral trainees, and graduate students.

In some embodiments, a professional can be assisted by determining whether specific genetic variants are present in a nucleic acid sample from a subject, and communicating information about genetic variants to a professional. After information about specific genetic variants is reported, a medical professional can take one or more actions that can affect subject care. For example, a medical professional can record information in the subject's medical record regarding the subject's risk of developing a neurological disorder. In some embodiments, a medical professional can record information regarding risk assessment, or otherwise transform the subject's medical record, to reflect the subject's current medical condition. In some embodiments, a medical professional can review and evaluate a subject's entire medical record and assess multiple treatment strategies for clinical intervention of a subject's condition.

A medical professional can initiate or modify treatment after receiving information regarding a subject's screening of a neurological disorder, for example. In some embodiments, a medical professional can recommend a change in therapy. In some embodiments, a medical professional can enroll a subject in a clinical trial for, by way of example, detecting correlations between a haplotype as described herein and any measurable or quantifiable parameter relating to the outcome of the treatment as described above.

In some embodiments, a medical professional can communicate information regarding a subject's screening of developing a neurological disorder to a subject or a subject's family. In some embodiments, a medical professional can provide a subject and/or a subject's family with information regarding a neurological disorder and risk assessment information, including treatment options, and referrals to specialists. In some embodiments, a medical professional can provide a copy of a subject's medical records to a specialist. In some embodiments, a research professional can apply information regarding a subject's risk of developing a neurological disorder to advance scientific research. In some embodiments, a research professional can obtain a subject's haplotype as described herein to evaluate a subject's enrollment, or continued participation, in a research study or clinical trial. In some embodiments, a research professional can communicate information regarding a subject's screening of a neurological disorder to a medical professional. In some embodiments, a research professional can refer a subject to a medical professional.

Any appropriate method can be used to communicate information to another person. For example, information can be given directly or indirectly to a professional and a laboratory technician can input a subject's genetic variation as described herein into a computer-based record. In some embodiments, information is communicated by making a physical alteration to medical or research records. For example, a medical professional can make a permanent notation or flag a medical record for communicating the risk assessment to other medical professionals reviewing the record. In addition, any type of communication can be used to communicate the risk assessment information. For example, mail, e-mail, telephone, and face-to-face interactions can be used. The information also can be communicated to a professional by making that information electronically available to the professional. For example, the information can be communicated to a professional by placing the information on a computer database such that the professional can access the information. In addition, the information can be communicated to a hospital, clinic, or research facility serving as an agent for the professional.

Results of these tests, and optionally interpretive information, can be returned to the subject, the health care provider or to a third party. The results can be communicated to the tested subject, for example, with a prognosis and optionally interpretive materials that can help the subject understand the test results and prognosis; used by a health care provider, for example, to determine whether to administer a specific drug, or whether a subject should be assigned to a specific category, for example, a category associated with a specific disease endophenotype, or with drug response or non-response; used by a third party such as a healthcare payer, for example, an insurance company or HMO, or other agency, to determine whether or not to reimburse a health care provider for services to the subject, or whether to approve the provision of services to the subject. For example, the healthcare payer can decide to reimburse a health care provider for treatments for a neurological disorder if the subject has a neurological disorder or has an increased risk of developing a neurological disorder.

Also provided herein are databases that include a list of genetic variations as described herein, and wherein the list can be largely or entirely limited to genetic variations identified as useful for screening a neurological disorder as described herein. The list can be stored, for example, on a flat file or computer-readable medium. The databases can further include information regarding one or more subjects, for example, whether a subject is affected or unaffected, clinical information such as endophenotype, age of onset of symptoms, any treatments administered and outcomes, for example, data relevant to pharmacogenomics, diagnostics, prognostics or theranostics, and other details, for example, data about the disorder in the subject, or environmental or other genetic factors. The databases can be used to detect correlations between a particular haplotype and the information regarding the subject.

The methods described herein can also include the generation of reports for use, for example, by a subject, care giver, or researcher, that include information regarding a subject's genetic variations, and optionally further information such as treatments administered, treatment history, medical history, predicted response, and actual response. The reports can be recorded in a tangible medium, e.g., a computer-readable disk, a solid state memory device, or an optical storage device.

Methods of Screening using Variations in Polypeptides

In some embodiments of the disclosure, screening of a neurological disorder can be made by examining or comparing changes in expression, localization, binding partners, and composition of a polypeptide encoded by a nucleic acid associated with a neurological disorder, for example, in those instances where the genetic variations of the present disclosure results in a change in the composition or expression of the polypeptide and/or RNA, for example, mRNAs, miRNAs, and other noncoding RNAs (ncRNAs). Thus, screening of a neurological disorder can be made by examining expression and/or composition of one of these polypeptides and/or RNA, or another polypeptide and/or RNA encoded by a nucleic acid associated with a neurological disorder, in those instances where the genetic variation of the present disclosure results in a change in the expression, localization, binding partners, and/or composition of the polypeptide and/or RNA. In some embodiments, screening can comprise diagnosing a subject. In some embodiments, screening can comprise determining a prognosis of a subject, for example, determining the susceptibility of developing a neurological disorder. In some embodiments, screening can comprise theranosing a subject.

The genetic variations described herein that show association to a neurological disorder can play a role through their effect on one or more of these nearby genes. For example, while not intending to be limited by theory, it is generally expected that a deletion of a chromosomal segment comprising a particular gene, or a fragment of a gene, can either result in an altered composition or expression, or both, of the encoded polypeptide and/or mRNA. Likewise, duplications, or high number copy number variations, are in general expected to result in increased expression of encoded polypeptide and/or RNA. Other possible mechanisms affecting genes within a genetic variation region include, for example, effects on transcription, effects on RNA splicing, alterations in relative amounts of alternative splice forms of mRNA, effects on RNA stability, effects on transport from the nucleus to cytoplasm, and effects on the efficiency and accuracy of translation. Thus, DNA variations can be detected directly, using the subjects unamplified or amplified genomic DNA, or indirectly, using RNA or DNA obtained from the subject's tissue(s) that are present in an aberrant form or expression level as a result of the genetic variations of the disclosure showing association to a neurological disorder.

In some embodiments, the genetic variations of the disclosure showing association to a neurological disorder can affect the expression of a gene within the genetic variation region. In some embodiments, a genetic variation affecting an exonic region of a gene can affect, disrupt, or modulate the expression of the gene. In some embodiments, a genetic variation affecting an intergenic region of a gene can affect, disrupt, or modulate the expression of the gene. Certain genetic variation regions can have flanking duplicated segments, and genes within such segments can have altered expression and/or composition as a result of such genomic alterations. Regulatory element affecting gene expression can be located far away, even as far as tens or hundreds of kilobases away, from the promoter region of a gene. Thus, in some embodiments, regulatory elements for genes that are located outside the genetic variation region can be located within the genetic variation, and thus be affected by the genetic variation. It is thus contemplated that the detection of the genetic variations described herein, can be used for assessing expression for one or more of associated genes not directly impacted by the genetic variations. In some embodiments, a genetic variation affecting an intergenic region of a gene can affect, disrupt, or modulate the expression of a gene located elsewhere in the genome, such as described above. For example, a genetic variation affecting an intergenic region of a gene can affect, disrupt, or modulate the expression of a transcription factor, located elsewhere in the genome, which regulates the gene.

In some embodiments, genetic variations of the disclosure showing association to a neurological disorder can affect polypeptide expression at the translational level. It can be appreciated by those skilled in the art that this can occur by increased or decreased expression of one or more microRNAs (miRNAs) that regulates expression of a polypeptide known to be important, or implicated, in the cause, onset, or progression of the neurological disease. Increased or decreased expression of the one or more miRNAs can result from gain or loss of the whole miRNA gene, disruption of a portion of the gene (e.g., by an indel or CNV), or even a single base change (SNP or SNV) that produces an altered, non-functional or aberrant functioning miRNA sequence. It can also be appreciated by those skilled in the art that the expression of polypeptide, for example, one known to cause a neurological disease by increased or decreased expression, can result due to a genetic variation that results in alteration of an existing miRNA binding site within the polypeptide's mRNA transcript, or even creates a new miRNA binding site that leads to aberrant polypeptide expression.

A variety of methods can be used for detecting polypeptide composition and/or expression levels, including but not limited to enzyme linked immunosorbent assays (ELISA), Western blots, spectroscopy, mass spectrometry, peptide arrays, colorimetry, electrophoresis, isoelectric focusing, immunoprecipitations, immunoassays, and immunofluorescence and other methods well-known in the art. A test nucleic acid sample from a subject can be assessed for the presence of an alteration in the expression and/or an alteration in composition of the polypeptide encoded by a nucleic acid associated with a neurological disorder. An "alteration" in the polypeptide expression or composition, as used herein, refers to an alteration in expression or composition in a test nucleic acid sample, as compared to the expression or composition of the polypeptide in a control nucleic acid sample. Such alteration can, for example, be an alteration in the quantitative polypeptide expression or can be an alteration in the qualitative polypeptide expression, for example, expression of a mutant polypeptide or of a different splicing variant, or a combination thereof. In some embodiments, screening of a neurological disorder can be made by detecting a particular splicing variant encoded by a nucleic acid associated with a neurological disorder, or a particular pattern of splicing variants.

Antibodies can be polyclonal or monoclonal and can be labeled or unlabeled. An intact antibody or a fragment thereof can be used. The term "labeled", with regard to the probe or antibody, is intended to encompass direct labeling of the probe or antibody by coupling a detectable substance to the probe or antibody, as well as indirect labeling of the probe or antibody by reactivity with another reagent that is directly labeled as previously described herein. Other non-limiting examples of indirect labeling include detection of a primary antibody using a labeled secondary antibody, for example, a fluorescently-labeled secondary antibody and end-labeling of a DNA probe with biotin such that it can be detected with fluorescently-labeled streptavidin.

Detecting Genetic Variations Associated with Parkinson's Disease

Described herein, are methods that can be used to detect genetic variations. Detecting specific genetic variations, for example, polymorphic markers and/or haplotypes, copy number, absence or presence of an allele, or genotype associated with a neurological disorder as described herein, can be accomplished by methods known in the art for analyzing nucleic acids and/or detecting sequences at polymorphic or genetically variable sites, for example, amplification techniques, hybridization techniques, sequencing, arrays, or any combination thereof. Thus, by use of these methods disclosed herein or other methods available to the person skilled in the art, one or more alleles at polymorphic markers, including microsatellites, SNPs, CNVs, or other types of genetic variations, can be identified in a nucleic acid sample obtained from a subject.

Nucleic Acids

The nucleic acids and polypeptides described herein can be used in methods and kits of the present disclosure. In some embodiments, aptamers that specifically bind the nucleic acids and polypeptides described herein can be used in methods and kits of the present disclosure. As used herein, a nucleic acid can comprise a deoxyribonucleotide (DNA) or ribonucleotide (RNA), whether singular or in polymers, naturally occurring or non-naturally occurring, double-stranded or single-stranded, coding, for example, a translated gene, or non-coding, for example, a regulatory region, or any fragments, derivatives, mimetics or complements thereof. In some embodiments, nucleic acids can comprise oligonucleotides, nucleotides, polynucleotides, nucleic acid sequences, genomic sequences, antisense nucleic acids, DNA regions, probes, primers, genes, regulatory regions, introns, exons, open-reading frames, binding sites, target nucleic acids and allele-specific nucleic acids.

A "probe," as used herein, includes a nucleic acid fragment for examining a nucleic acid in a specimen using the hybridization reaction based on the complementarity of nucleic acid.

"A "hybrid" as used herein, includes a double strand formed between any one of the above-mentioned nucleic acid, within the same type, or across different types, including DNA-DNA, DNA-RNA, RNA-RNA or the like.

"Isolated" nucleic acids, as used herein, are separated from nucleic acids that normally flank the gene or nucleotide sequence (as in genomic sequences) and/or has been completely or partially purified from other transcribed sequences (e.g., as in an RNA library). For example, isolated nucleic acids of the disclosure can be substantially isolated with respect to the complex cellular milieu in which it naturally occurs, or culture medium when produced by recombinant techniques, or chemical precursors or other chemicals when chemically synthesized. In some instances, the isolated material can form part of a composition, for example, a crude extract containing other substances, buffer system or reagent mix. In some embodiments, the material can be purified to essential homogeneity using methods known in the art, for example, by polyacrylamide gel electrophoresis (PAGE) or column chromatography (e.g., HPLC). With regard to genomic DNA (gDNA), the term "isolated" also can refer to nucleic acids that are separated from the chromosome with which the genomic DNA is naturally associated. For example, the isolated nucleic acid molecule can contain less than about 250 kb, 200 kb, 150 kb, 100 kb, 75 kb, 50 kb, 25 kb, 10 kb, 5 kb, 4 kb, 3 kb, 2 kb, 1 kb, 0.5 kb or 0.1 kb of the nucleotides that flank the nucleic acid molecule in the gDNA of the cell from which the nucleic acid molecule is derived.

Nucleic acids can be fused to other coding or regulatory sequences can be considered isolated. For example, recombinant DNA contained in a vector is included in the definition of "isolated" as used herein. In some embodiments, isolated nucleic acids can include recombinant DNA molecules in heterologous host cells or heterologous organisms, as well as partially or substantially purified DNA molecules in solution. Isolated nucleic acids also encompass in vivo and in vitro RNA transcripts of the DNA molecules of the present disclosure. An isolated nucleic acid molecule or nucleotide sequence can be synthesized chemically or by recombinant means. Such isolated nucleotide sequences can be useful, for example, in the manufacture of the encoded polypeptide, as probes for isolating homologous sequences (e.g., from other mammalian species), for gene mapping (e.g., by in situ hybridization with chromosomes), or for detecting expression of the gene, in tissue (e.g., human tissue), such as by Northern blot analysis or other hybridization techniques disclosed herein. The disclosure also pertains to nucleic acid sequences that hybridize under high stringency hybridization conditions, such as for selective hybridization, to a nucleotide sequence described herein Such nucleic acid sequences can be detected and/or isolated by allele- or sequence-specific hybridization (e.g., under high stringency conditions). Stringency conditions and methods for nucleic acid hybridizations are well known to the skilled person (see, e.g., Current Protocols in Molecular Biology, Ausubel, F. et al., John Wiley & Sons, (1998), and Kraus, M. and Aaronson, S., Methods Enzymol., 200:546-556 (1991), the entire teachings of which are incorporated by reference herein.

Calculations of "identity" or "percent identity" between two or more nucleotide or amino acid sequences can be determined by aligning the sequences for optimal comparison purposes (e.g., gaps can be introduced in the sequence of a first sequence). The nucleotides at corresponding positions are then compared, and the percent identity between the two sequences is a function of the number of identical positions shared by the sequences (i.e., % identity=# of identical positions/total # of positions×100). For example, a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which need to be introduced for optimal alignment of the two sequences. In some embodiments, the length of a sequence aligned for comparison purposes is at least 30%, at least 40%, at least 50%, at least 60%, at least 70%, at least 80%, at least 90%, or at least 95%, of the length of the reference sequence. The actual comparison of the two sequences can be accomplished by well-known methods, for example, using a mathematical algorithm. A non-limiting example of such a mathematical algorithm is described in Karlin, S, and Altschul, S., Proc. Natl. Acad. Sci. USA, 90-5873-5877 (1993). Such an algorithm is incorporated into the NBLAST and XBLAST programs (version 2.0), as described in Altschul, S. et al., Nucleic Acids Res., 25:3389-3402 (1997). When utilizing BLAST and Gapped BLAST programs, any relevant parameters of the respective programs (e.g., NBLAST) can be used. For example, parameters for sequence comparison can be set at score=100, word length=12, or can be varied (e.g., W=5 or W=20). Other examples include the algorithm of Myers and Miller, CABIOS (1989), ADVANCE, ADAM, BLAT, and FASTA. In some embodiments, the percent identity between two amino acid sequences can be accomplished using, for example, the GAP program in the GCG software package (Accelrys, Cambridge, UK).

"Probes" or "primers" can be oligonucleotides that hybridize in a base-specific manner to a complementary strand of a nucleic acid molecule. Probes can include primers, which can be a single-stranded oligonucleotide probe that can act as a point of initiation of template-directed DNA synthesis using methods including but not limited to, polymerase chain reaction (PCR) and ligase chain reaction (LCR) for amplification of a target sequence. Oligonucleotides, as described herein, can include segments or fragments of nucleic acid sequences, or their complements. In some embodiments, DNA segments can be between 5 and 10,000 contiguous bases, and can range from 5, 10, 12, 15, 20, or 25 nucleotides to 10, 15, 20, 25, 30, 40, 50, 100, 200, 500, 1000 or 10,000 nucleotides. In addition to DNA and RNA, probes and primers can include polypeptide nucleic acids (PNA), as described in Nielsen, P. et al., Science 254: 1497-1500 (1991). A probe or primer can comprise a region of nucleotide sequence that hybridizes to at least about 15, typically about 20-25, and in certain embodiments about 40, 50 or 75, consecutive nucleotides of a nucleic acid molecule.

The present disclosure also provides isolated nucleic acids, for example, probes or primers, that contain a fragment or portion that can selectively hybridize to a nucleic acid that comprises, or consists of, a nucleotide sequence, wherein the nucleotide sequence can comprise at least one polymorphism or polymorphic allele contained in the genetic variations described herein or the wild-type nucleotide that is located at the same position, or the compliments thereof. In some embodiments, the probe or primer can be at least 70% identical, at least 80% identical, at least 85% identical, at least 90% identical, or at least 95% identical, to the contiguous nucleotide sequence or to the complement of the contiguous nucleotide sequence.

In a preferred embodiment, a nucleic acid probe can be an oligonucleotide capable of hybridizing with a complementary regions of a gene associated with a neurological disorder containing a genetic variation described herein. The nucleic acid fragments of the disclosure can be used as probes or primers in assays such as those described herein.

The nucleic acids of the disclosure, such as those described above, can be identified and isolated using standard molecular biology techniques well known to the skilled person. In some embodiments, DNA can be amplified and/or can be labeled (e.g., radiolabeled, fluorescently labeled) and used as a probe for screening, for example, a cDNA library derived from an organism. cDNA can be derived from mRNA and can be contained in a suitable vector. For example, corresponding clones can be isolated, DNA obtained fallowing in vivo excision, and the cloned insert can be sequenced in either or both orientations by art-recognized methods to identify the correct reading frame encoding a polypeptide of the appropriate molecular weight. Using these or similar methods, the polypeptide and the DNA encoding the polypeptide can be isolated, sequenced and further characterized.

In some embodiments, nucleic acid can comprise one or more polymorphisms, variations, or mutations, for example, single nucleotide polymorphisms (SNPs), copy number variations (CNVs), for example, insertions, deletions, inversions, and translocations. In some embodiments, nucleic acids can comprise analogs, for example, phosphorothioates, phosphoramidates, methyl phosphonate, chiralmethyl phosphonates, 2-0-methyl ribonucleotides, or modified nucleic acids, for example, modified backbone residues or linkages, or nucleic acids combined with carbohydrates, lipids, polypeptide or other materials, or peptide nucleic acids (PNAs), for example, chromatin, ribosomes, and transcriptosomes. In some embodiments nucleic acids can comprise nucleic acids in various structures, for example, A DNA, B DNA, Z-form DNA, siRNA, tRNA, and ribozymes. In some embodiments, the nucleic acid may be naturally or non-naturally polymorphic, for example, having one or more sequence differences, for example, additions, deletions and/or substitutions, as compared to a reference sequence. In some embodiments, a reference sequence can be based on publicly available information, for example, the U.C. Santa Cruz Human Genome Browser Gateway (genome.ucsc.edu/cgi-bin/hg-Gateway) or the NCBI website (www.ncbi.nlm.nih.gov). In some embodiments, a reference sequence can be determined by a practitioner of the present disclosure using methods well known in the art, for example, by sequencing a reference nucleic acid.

In some embodiment a probe can hybridize to an allele, SNP, or CNV as described herein. In some embodiments, the probe can bind to another marker sequence associated with a neurological disorder as described herein.

One of skill in the art would know how to design a probe so that sequence specific hybridization can occur only if a particular allele is present in a genomic sequence from a test nucleic acid sample. The disclosure can also be reduced to practice using any convenient genotyping method, including commercially available technologies and methods for genotyping particular genetic variations Control probes can also be used, for example, a probe that binds a less variable sequence, for example, a repetitive DNA associated with a centromere of a chromosome, can be used as a control. In some embodiments, probes can be obtained from commercial sources. In some embodiments, probes can be synthesized, for example, chemically or in vitro, or made from chromosomal or genomic DNA through standard techniques. In some embodiments sources of DNA that can be used include genomic DNA, cloned DNA sequences, somatic cell hybrids that contain one, or a part of one, human chromosome along with the normal chromosome complement of the host, and chromosomes purified by flow cytometry or microdissection. The region of interest can be isolated through cloning, or by site-specific amplification using PCR.

One or more nucleic acids for example, a probe or primer, can also be labeled, for example, by direct labeling, to comprise a detectable label. A detectable label can comprise any label capable of detection by a physical, chemical, or a biological process for example, a radioactive label, such as $^{32}P$ or $^{3}H$, a fluorescent label, such as FITC, a chromophore label, an affinity-ligand label, an enzyme label, such as alkaline phosphatase, horseradish peroxidase, or 12 galactosidase, an enzyme cofactor label, a hapten conjugate label, such as digoxigenin or dinitrophenyl, a Raman signal generating label, a magnetic label, a spin label, an epitope label, such as the FLAG or HA epitope, a luminescent label, a heavy atom label, a nanoparticle label, electrochemical label, a light scattering label, a spherical shell label, semiconductor nanocrystal label, such as quantum dots (described in U.S. Pat. No. 6,207,392), and probes labeled with any other signal generating label known to those of skill in the art, wherein a label can allow the probe to be visualized with or without a secondary detection molecule. A nucleotide can be directly incorporated into a probe with standard techniques, for example, nick translation, random priming, and PCR labeling. A "signal," as used herein, include a signal suitably detectable and measurable by appropriate means, including fluorescence, radioactivity, chemiluminescence, and the like.

Non-limiting examples of label moieties useful for detection include, without limitation, suitable enzymes such as horseradish peroxidase, alkaline phosphatase, beta-galactosidase, or acetylcholinesterase; members of a binding pair that are capable of forming complexes such as streptavidin/biotin, avidin/biotin or an antigen/antibody complex including, for example, rabbit IgG and anti-rabbit IgG; fluorophores such as umbelliferone, fluorescein, fluorescein isothiocyanate, rhodamine, tetramethyl rhodamine, eosin, green fluorescent protein, erythrosin, coumarin, methyl coumarin, pyrene, malachite green, stilbene, lucifer yellow, Cascade Blue, Texas Red, dichlorotriazinylamine fluorescein, dansyl chloride, phycoerythrin, fluorescent lanthanide complexes such as those including Europium and Terbium, cyanine dye family members, such as Cy3 and Cy5, molecular beacons and fluorescent derivatives thereof, as well as others known in the art as described, for example, in Principles of Fluorescence Spectroscopy, Joseph R. Lakowicz (Editor), Plenum Pub Corp, 2nd edition (July 1999) and the 6th Edition of the Molecular Probes Handbook by Richard P. Hoagland; a luminescent material such as luminol; light scattering or plasmon resonant materials such as gold or silver particles or quantum dots; or radioactive material include $^{14}C$, $^{123}I$, $^{124}I$, $^{125}I$, Tc99m, $^{32}P$, $^{33}P$, $^{35}S$ or $^{3}H$.

Other labels can also be used in the methods of the present disclosure, for example, backbone labels. Backbone labels comprise nucleic acid stains that bind nucleic acids in a sequence independent manner. Non-limiting examples include intercalating dyes such as phenanthridines and acridines (e.g., ethidium bromide, propidium iodide, hexidium iodide, dihydroethidium, ethidium homodimer-1 and -2, ethidium monoazide, and ACMA); some minor grove binders such as indoles and imidazoles (e.g., Hoechst 33258, Hoechst 33342, Hoechst 34580 and DAPI); and miscellaneous nucleic acid stains such as acridine orange (also capable of intercalating), 7-AAD, actinomycin D, LDS751, and hydroxystilbamidine. All of the aforementioned nucleic acid stains are commercially available from suppliers such as Molecular Probes, Inc. Still other examples of nucleic acid stains include the following dyes from Molecular Probes: cyanine dyes such as SYTOX Blue, SYTOX Green, SYTOX Orange, POPO-1, POPO-3, YOYO-1, YOYO-3, TOTO-1, TOTO-3, JOJO-1, LOLO-1, BOBO-1, BOBO-3, PO-PRO-1, PO-PRO-3, BO-PRO-1, BO-PRO-3, TO-PRO-1, TO-PRO-3, TO-PRO-5, JO-PRO-1, LO-PRO-1, YO-PRO-1, YO-PRO-3, PicoGreen, OliGreen, RiboGreen, SYBR Gold, SYBR Green I, SYBR Green II, SYBR DX, SYTO-40, -41, -42, -43, -44, -45 (blue), SYTO-13, -16, -24, -21, -23, -12, -11, -20, -22, -15, -14, -25 (green), SYTO-81, -80, -82, -83, -84, -85 (orange), SYTO-64, -17, -59, -61, -62, -60, -63 (red).

In some embodiments, fluorophores of different colors can be chosen, for example, 7-amino-4-methylcoumarin-3-acetic acid (AMCA), 5-(and -6)-carboxy-X-rhodamine, lissamine rhodamine B, 5-(and -6)-carboxyfluorescein, fluorescein-5-isothiocyanate (FITC), 7-diethylaminocoumarin-3-carboxylic acid, tetramethylrhodamine-5-(and -6)-isothiocyanate, 5-(and -6)-carboxytetramethylrhodamine, 7-hydroxycoumarin-3-carboxylic acid, 6-[fluorescein 5-(and -6)-carboxamido]hexanoic acid, N-(4,4-difluoro-5,7-dimethyl-4-bora-3a,4a diaza-3-indacenepropionic acid, eosin-5-isothiocyanate, erythrosin-5-isothiocyanate, TRITC, rhodamine, tetramethylrhodamine, R-phycoerythrin, Cy-3, Cy-5, Cy-7, Texas Red, Phar-Red, allophycocyanin (APC), and CASCADE™ blue acetylazide, such that each probe in or not in a set can be distinctly visualized. In some embodiments, fluorescently labeled probes can be viewed with a fluorescence microscope and an appropriate filter for each fluorophore, or by using dual or triple bandpass filter sets to observe multiple fluorophores. In some embodiments, techniques such as flow cytometry can be used to examine the hybridization pattern of the probes.

In other embodiments, the probes can be indirectly labeled, for example, with biotin or digoxygenin, or labeled with radioactive isotopes such as $^{32}P$ and/or $^{3}H$. As a non-limiting example, a probe indirectly labeled with biotin can be detected by avidin conjugated to a detectable marker. For example, avidin can be conjugated to an enzymatic marker such as alkaline phosphatase or horseradish peroxidase. In some embodiments, enzymatic markers can be detected using colorimetric reactions using a substrate and/or a catalyst for the enzyme. In some embodiments, catalysts for alkaline phosphatase can be used, for example, 5-bromo-4-chloro-3-indolylphosphate and nitro blue tetrazolium. In some embodiments, a catalyst can be used for horseradish peroxidase, for example, diaminobenzoate.

Methods of Detecting Genetic Variations

In some embodiments, standard techniques for genotyping for the presence genetic variations, for example, amplification, can be used. Amplification of nucleic acids can be accomplished using methods known in the art. Generally, sequence information from the region of interest can be used to design oligonucleotide primers that can be identical or similar in sequence to opposite strands of a template to be amplified. In some embodiments, amplification methods can include but are not limited to, fluorescence-based techniques utilizing PCR, for example, ligase chain reaction (LCR), Nested PCR, transcription amplification, self-sustained sequence replication, nucleic acid based sequence amplification (NASBA), and multiplex ligation-dependent probe amplification (MLPA). Guidelines for selecting primers for PCR amplification are well known in the art. In some embodiments, a computer program can be used to design primers, for example, Oligo (National Biosciences, Inc, Plymouth Minn.), MacVector (Kodak/IBI), and GCG suite of sequence analysis programs.

In some embodiments, commercial methodologies available for genotyping, for example, SNP genotyping, can be used, but are not limited to, TaqMan genotyping assays (Applied Biosystems), SNPlex platforms (Applied Biosystems), gel electrophoresis, capillary electrophoresis, size exclusion chromatography, mass spectrometry, for example, MassARRAY system (Sequenom), minisequencing methods, real-time Polymerase Chain Reaction (PCR), Bio-Plex system (BioRad), CEQ and SNPstream systems (Beckman), array hybridization technology, for example, Affymetrix GeneChip (Perlegen), BeadArray Technologies, for example, Illumina GoldenGate and Infinium assays, array tag technology, Multiplex Ligation-dependent Probe Amplification (MLPA), and endonuclease-based fluorescence hybridization technology (Invader; Third Wave). PCR can be a procedure in which target nucleic acid is amplified in a manner similar to that described in U.S. Pat. No. 4,683,195 and subsequent modifications of the procedure described therein. PCR can include a three phase temperature cycle of denaturation of DNA into single strands, annealing of primers to the denatured strands, and extension of the primers by a thermostable DNA polymerase enzyme. This cycle can be repeated so that there are enough copies to be detected and analyzed. In some embodiments, real-time quantitative PCR can be used to determine genetic variations, wherein quantitative PCR can permit both detection and quantification of a DNA sequence in a nucleic acid sample, for example, as an absolute number of copies or as a relative amount when normalized to DNA input or other normalizing genes. In some embodiments, methods of quantification can include the use of fluorescent dyes that can intercalate with double-stranded DNA, and modified DNA oligonucleotide probes that can fluoresce when hybridized with a complementary DNA.

In some embodiments of the disclosure, a nucleic acid sample obtained from the subject can be collected and PCR can used to amplify a fragment of nucleic acid that comprises one or more genetic variations that can be indicative of a susceptibility to a neurological disorder. In some embodiments, detection of genetic variations can be accomplished by expression analysis, for example, by using quantitative PCR. In some embodiments, this technique can assess the presence or absense of a genetic alteration in the expression or composition of one or more polypeptides or splicing variants encoded by a nucleic acid associated with a neurological disorder.

In a preferred embodiment, the nucleic acid sample from a subject containing a SNP can be amplified by PCR prior to detection with a probe. In such an embodiment, the amplified DNA serves as the template for a detection probe and, in some embodiments, an enhancer probe. Certain embodiments of the detection probe, the enhancer probe, and/or the primers used for amplification of the template by PCR can comprise the use of modified bases, for example, modified A, T, C, G, and U, wherein the use of modified bases can be useful for adjusting the melting temperature of the nucleotide probe and/or primer to the template DNA, In a preferred embodiment, modified bases are used in the design of the detection nucleotide probe. Any modified base known to the skilled person can be selected in these methods, and the selection of suitable bases is well within the scope of the skilled person based on the teachings herein and known bases available from commercial sources as known to the skilled person.

In some embodiments, identification of genetic variations can be accomplished using hybridization methods. The presence of a specific marker allele or a particular genomic segment comprising a genetic variation, or representative of a genetic variation, can be indicated by sequence-specific hybridization of a nucleic acid probe specific for the particular allele or the genetic variation in a nucleic acid sample that has or has not been amplified but methods described herein. The presence of more than one specific marker allele or several genetic variations can be indicated by using two or more sequence-specific nucleic acid probes, wherein each is specific for a particular allele and/or genetic variation.

Hybridization can be performed by methods well known to the person skilled in the art, for example, hybridization techniques such as fluorescent in situ hybridization (FISH), Southern analysis, Northern analysis, or in situ hybridization. In some embodiments, hybridization refers to specific hybridization, wherein hybridization can be performed with no mismatches. Specific hybridization, if present, can be using standard methods. In some embodiments, if specific hybridization occurs between a nucleic acid probe and the nucleic acid in the nucleic acid sample, the nucleic acid sample can contain a sequence that can be complementary to a nucleotide present in the nucleic acid probe. In some embodiments, if a nucleic acid probe can contain a particular allele of a polymorphic marker, or particular alleles for a plurality of markers, specific hybridization is indicative of the nucleic acid being completely complementary to the nucleic acid probe, including the particular alleles at polymorphic markers within the probe. In some embodiments a probe can contain more than one marker alleles of a particular haplotype, for example, a probe can contain alleles complementary to 2, 3, 4, 5 or all of the markers that make up a particular haplotype. In some embodiments detection of one or more particular markers of the haplotype in the nucleic acid sample is indicative that the source of the nucleic acid sample has the particular haplotype.

In some embodiments, PCR conditions and primers can be developed that amplify a product only when the variant allele is present or only when the wild type allele is present, for example, allele-specific PCR. In some embodiments of allele-specific PCR, a method utilizing a detection oligonucleotide probe comprising a fluorescent moiety or group at its 3' terminus and a quencher at its 5' terminus, and an enhancer oligonucleotide, can be employed, as described by Kutyavin et al. (Nucleic Acid Res. 34:e128 (2006)).

An allele-specific primer/probe can be an oligonucleotide that is specific for particular a polymorphism can be prepared using standard methods. In some embodiments, allele-specific oligonucleotide probes can specifically hybridize to a nucleic acid region that contains a genetic variation. In some embodiments, hybridization conditions can be selected such that a nucleic acid probe can specifically bind to the sequence of interest, for example, the variant nucleic acid sequence.

In some embodiments, allele-specific restriction digest analysis can be used to detect the existence of a polymorphic variant of a polymorphism, if alternate polymorphic variants of the polymorphism can result in the creation or elimination of a restriction site. Allele-specific restriction digests can be performed, for example, with the particular restriction enzyme that can differentiate the alleles. In some embodiments, PCR can be used to amplify a region comprising the polymorphic site, and restriction fragment length polymorphism analysis can be conducted. In some embodiments, for sequence variants that do not alter a common restriction site, mutagenic primers can be designed that can introduce one or more restriction sites when the variant allele is present or when the wild type allele is present.

In some embodiments, fluorescence polarization template-directed dye-terminator incorporation (FP-TDI) can be used to determine which of multiple polymorphic variants of a polymorphism can be present in a subject. Unlike the use of allele-specific probes or primers, this method can employ primers that can terminate adjacent to a polymorphic site, so that extension of the primer by a single nucleotide can result in incorporation of a nucleotide complementary to the polymorphic variant at the polymorphic site.

In some embodiments, DNA containing an amplified portion can be dot-blotted, using standard methods and the blot contacted with the oligonucleotide probe. The presence of specific hybridization of the probe to the DNA can then be detected. The methods can include determining the genotype of a subject with respect to both copies of the polymorphic site present in the genome, wherein if multiple polymorphic variants exist at a site, this can be appropriately indicated by specifying which variants are present in a subject. Any of the detection means described herein can be used to determine the genotype of a subject with respect to one or both copies of the polymorphism present in the subject's genome.

In some embodiments, a peptide nucleic acid (PNA) probe can be used in addition to, or instead of, a nucleic acid probe in the methods described herein. A PNA can be a DNA mimic having a peptide-like, inorganic backbone, for example, N-(2-aminoethyl) glycine units with an organic base (A, G, C, T or U) attached to the glycine nitrogen via a methylene carbonyl linker.

Nucleic acid sequence analysis can also be used to detect genetic variations, for example, genetic variations can be detected by sequencing exons, introns, 5' untranslated sequences, or 3' untranslated sequences. One or more methods of nucleic acid analysis that are available to those skilled in the art can be used to detect genetic variations, including but not limited to, direct manual sequencing, automated fluorescent sequencing, single-stranded conformation polymorphism assays (SSCP); clamped denaturing gel electrophoresis (CDGE); denaturing gradient gel electrophoresis (DGGE), two-dimensional gel electrophoresis (2DGE or TDGE); conformational sensitive gel electrophoresis (CSGE); denaturing high performance liquid chromatography (DHPLC), infrared matrix-assisted laser desorption/ionization (IR-MALDI) mass spectrometry, mobility shift analysis, quantitative real-time PCR, restriction enzyme analysis, heteroduplex analysis; chemical mismatch cleavage (CMC), RNase protection assays, use of polypeptides that recognize nucleotide mismatches, allele-specific PCR, real-time pyrophosphate DNA sequencing, PCR amplification in combination with denaturing high performance liquid chromatography (dHPLC), and combinations of such methods.

Sequencing can be accomplished through classic Sanger sequencing methods, which are known in the art. In a preferred embodiment sequencing can be performed using high-throughput sequencing methods some of which allow detection of a sequenced nucleotide immediately after or upon its incorporation into a growing strand, for example, detection of sequence in substantially real time or real time. In some cases, high throughput sequencing generates at least 1,000, at least 5,000, at least 10,000, at least 20,000, at least 30,000, at least 40,000, at least 50,000, at least 100,000 or at least 500,000 sequence reads per hour; with each read being at least 50, at least 60, at least 70, at least 80, at least 90, at least 100, at least 120 or at least 150 bases per read (or 500-1,000 bases per read for 454).

High-throughput sequencing methods can include but are not limited to, Massively Parallel Signature Sequencing (MPSS, Lynx Therapeutics), Polony sequencing, 454 pyrosequencing, Illumina (Solexa) sequencing, SOLiD sequencing, on semiconductor sequencing, DNA nanoball sequencing, Helioscope™ single molecule sequencing, Single Molecule SMRT™ sequencing, Single Molecule real time (RNAP) sequencing, Nanopore DNA sequencing, and/or sequencing by hybridization, for example, a non-enzymatic method that uses a DNA microarray, or microfluidic Sanger sequencing.

In some embodiments, high-throughput sequencing can involve the use of technology available by Helicos BioSciences Corporation (Cambridge, Mass.) such as the Single Molecule Sequencing by Synthesis (SMSS) method. SMSS is unique because it allows for sequencing the entire human genome in up to 24 hours. This fast sequencing method also allows for detection of a SNP/nucleotide in a sequence in substantially real time or real time. Finally, SMSS is powerful because, like the MIP technology, it does not use a pre-amplification step prior to hybridization. SMSS does not use any amplification. SMSS is described in US Publication Application Nos. 20060024711; 20060024678; 20060012793; 20060012784; and 20050100932. In some embodiments, high-throughput sequencing involves the use of technology available by 454 Life Sciences, Inc. (a Roche company, Branford, Conn.) such as the PicoTiterPlate device which includes a fiber optic plate that transmits chemiluminescent signal generated by the sequencing reaction to be recorded by a CCD camera in the instrument. This use of fiber optics allows for the detection of a minimum of 20 million base pairs in 4.5 hours.

In some embodiments, PCR-amplified single-strand nucleic acid can be hybridized to a primer and incubated with a polymerase, ATP sulfurylase, luciferase, apyrase, and the substrates luciferin and adenosine 5' phosphosulfate. Next, deoxynucleotide triphosphates corresponding to the bases A, C, G, and T (U) can be added sequentially. A base incorporation can be accompanied by release of pyrophosphate, which can be converted to ATP by sulfurylase, which can drive synthesis of oxyluciferin and the release of visible light. Since pyrophosphate release can be equimolar with the number of incorporated bases, the light given off can be proportional to the number of nucleotides adding in any one step. The process can repeat until the entire sequence can be determined. In some embodiments, pyrosequencing can be utilized to analyze amplicons to determine whether breakpoints are present. In some embodiments, pyrosequencing can map surrounding sequences as an internal quality control.

Pyrosequencing analysis methods are known in the art. Sequence analysis can include a four-color sequencing by ligation scheme (degenerate ligation), which involves hybridizing an anchor primer to one of four positions. Then an enzymatic ligation reaction of the anchor primer to a population of degenerate nonamers that are labeled with fluorescent dyes can be performed. At any given cycle, the population of nonamers that is used can be structured such that the identity of one of its positions can be correlated with the identity of the fluorophore attached to that nonamer. To the extent that the ligase discriminates for complementarily at that queried position, the fluorescent signal can allow the inference of the identity of the base. After performing the ligation and four-color imaging, the anchor primer: nonamer complexes can be stripped and a new cycle begins. Methods to image sequence information after performing ligation are known in the art.

In some embodiments, analysis by restriction enzyme digestion can be used to detect a particular genetic variation if the genetic variation results in creation or elimination of one or more restriction sites relative to a reference sequence. In some embodiments, restriction fragment length polymorphism (RFLP) analysis can be conducted, wherein the digestion pattern of the relevant DNA fragment indicates the presence or absence of the particular genetic variation in the nucleic acid sample.

In some embodiments, arrays of oligonucleotide probes that can be complementary to target nucleic acid sequence segments from a subject can be used to identify genetic variations. In some embodiments, an array of oligonucleotide probes comprises an oligonucleotide array, for example, a microarray. In some embodiments, the present disclosure features arrays that include a substrate having a plurality of addressable areas, and methods of using them. At least one area of the plurality includes a nucleic acid probe that binds specifically to a sequence comprising a genetic variation, and can be used to detect the absence or presence of the genetic variation, for example, one or more SNPs, microsatellites, or CNVs, as described herein, to determine or identify an allele or genotype. For example, the array can include one or more nucleic acid probes that can be used to detect a genetic variation associated with a gene and/or gene product such as those listed in Table 2 or 3. In some embodiments, the array can further comprise at least one area that includes a nucleic acid probe that can be used to specifically detect another marker associated with a neurological disorder, for example, Parkinson's Disease, as described herein.

Microarray hybridization can be performed by hybridizing a nucleic acid of interest, for example, a nucleic acid encompassing a genetic variation, with the array and detecting hybridization using nucleic acid probes. In some embodiments, the nucleic acid of interest is amplified prior to hybridization. Hybridization and detecting can be carried out according to standard methods described in Published PCT Applications: WO 92/10092 and WO 95/11995, and U.S. Pat. No. 5,424,186. For example, an array can be scanned to determine the position on the array to which the nucleic acid hybridizes. The hybridization data obtained from the scan can be, for example, in the form of fluorescence intensities as a function of location on the array.

Arrays can be formed on substrates fabricated with materials such as paper; glass; plastic, for example, polypropylene, nylon, or polystyrene; polyacrylamide; nitrocellulose; silicon; optical fiber; or any other suitable solid or semisolid support; and can be configured in a planar, for example, glass plates or silicon chips); or three dimensional, for example, pins, fibers, beads, particles, microtiter wells, and capillaries, configuration.

Methods for generating arrays are known in the art and can include for example; photolithographic methods (U.S. Pat. Nos. 5,143,854, 5,510,270 and 5,527,681); mechanical methods, for example, directed-flow methods (U.S. Pat. No. 5,384,261); pin-based methods (U.S. Pat. No. 5,288,514); bead-based techniques (PCT US/93/04145); solid phase oligonucleotide synthesis methods; or by other methods known to a person skilled in the art (see, e.g., Bier, F. F., et al. Adv Biochem Eng Biotechnol 109:433-53 (2008); Hoheisel, J. D., Nat Rev Genet. 7: 200-10 (2006); Fan, J. B., et al. Methods Enzymol 410:57-73 (2006); Raqoussis, J. & Elvidge, G., Expert Rev Mol Design 6: 145-52 (2006); Mockler, T. C., et al. Genomics 85: 1-15 (2005), and references cited therein, the entire teachings of each of which are incorporated by reference herein). Many additional descriptions of the preparation and use of oligonucleotide arrays for detection of polymorphisms can be found, for example, in U.S. Pat. Nos. 6,858,394, 6,429,027, 5,445,934, 5,700,637, 5,744,305, 5,945,334, 6,054,270, 6,300,063, 6,733,977, 7,364,858, EP 619 321, and EP 373 203, the entire teachings of which are incorporated by reference herein. Methods for array production, hybridization, and analysis are also described in Snijders et al., Nat. Genetics 29:263-264 (2001); Klein et al., Proc. Natl. Acad. Sci. USA 96:4494-4499 (1999); Albertson et al., Breast Cancer Research and Treatment 78:289-298 (2003); and Snijders et al., "BAC microarray based comparative genomic hybridization," in: Zhao et al. (eds), Bacterial Artificial Chromosomes: Methods and Protocols, Methods in Molecular Biology, Humana Press, 2002.

In some embodiments, oligonucleotide probes forming an array can be attached to a substrate by any number of techniques, including, but not limited to, in situ synthesis, for example, high-density oligonucleotide arrays, using photolithographic techniques; spotting/printing a medium to low density on glass, nylon, or nitrocellulose; by masking; and by dot-blotting on a nylon or nitrocellulose hybridization membrane. In some embodiments, oligonucleotides can be immobilized via a linker, including but not limited to, by covalent, ionic, or physical linkage. Linkers for immobilizing nucleic acids and polypeptides, including reversible or cleavable linkers, are known in the art (U.S. Pat. No. 5,451,683 and WO98/20019). In some embodiments, oligonucleotides can be non-covalently immobilized on a substrate by hybridization to anchors, by means of magnetic beads, or in a fluid phase, for example, in wells or capillaries.

An array can comprise oligonucleotide hybridization probes capable of specifically hybridizing to different genetic variations. In some embodiments, oligonucleotide arrays can comprise a plurality of different oligonucleotide probes coupled to a surface of a substrate in different known locations. In some embodiments, oligonucleotide probes can exhibit differential or selective binding to polymorphic sites, and can be readily designed by one of ordinary skill in the art, for example, an oligonucleotide that is perfectly complementary to a sequence that encompasses a polymorphic site, for example, a sequence that includes the polymorphic site, within it, or at one end, can hybridize preferentially to a nucleic acid comprising that sequence, as opposed to a nucleic acid comprising an alternate polymorphic variant.

In some embodiments, arrays can include multiple detection blocks, for example, multiple groups of probes designed for detection of particular polymorphisms. In some embodiments, these arrays can be used to analyze multiple different polymorphisms. In some embodiments, detection blocks can be grouped within a single array or in multiple, separate arrays, wherein varying conditions, for example, conditions optimized for particular polymorphisms, can be used during hybridization. General descriptions of using oligonucleotide arrays for detection of polymorphisms can be found, for example, in U.S. Pat. Nos. 5,858,659 and 5,837,832. In addition to oligonucleotide arrays, cDNA arrays can be used similarly in certain embodiments.

The methods described herein can include but are not limited to providing an array as described herein; contacting the array with a nucleic acid sample, and detecting binding of a nucleic acid from the nucleic acid sample to the array. In some embodiments, the method can comprise amplifying nucleic acid from the nucleic acid sample, for example, a region associated with a neurological disorder or a region that includes another region associated with a neurological disorder. In some embodiments, the methods described herein can include using an array that can identify differential expression patterns or copy numbers of one or more genes in nucleic acid samples from control and affected individuals. For example, arrays of probes to a marker described herein can be used to identify genetic variations between DNA from an affected subject, and control DNA obtained from an individual that does not have a neurological disorder. Since the nucleotides on the array can contain sequence tags, their positions on the array can be accurately known relative to the genomic sequence In some embodiments, it can be desirable to employ methods that can detect the presence of multiple genetic variations, for example, polymorphic variants at a plurality of polymorphic sites, in parallel or substantially simultaneously. In some embodiments, these methods can comprise oligonucleotide arrays and other methods, including methods in which reactions, for example, amplification and hybridization, can be performed in individual vessels, for example, within individual wells of a multi-well plate or other vessel.

Determining the identity of a genetic variation can also include or consist of reviewing a subject's medical history, where the medical history includes information regarding the identity, copy number, presence or absence of one or more alleles or SNPs in the subject, e.g., results of a genetic test.

In some embodiments extended runs of homozygosity (ROH) may be useful to map recessive disease genes in outbred populations. Furthermore, even in complex disorders, a high number of affected individuals may have the same haplotype in the region surrounding a disease mutation. Therefore, a rare pathogenic variant and surrounding haplotype can be enriched in frequency in a group of affected individuals compared with the haplotype frequency in a cohort of unaffected controls. Homozygous haplotypes (HH) that are shared by multiple affected individuals can be important for the discovery of recessive disease genes in complex disorders such as PD. In some embodiments, the traditional homozygosity mapping method can be extended by analysing the haplotype within shared ROH regions to identify homozygous segments of identical haplotype that are present uniquely or at a higher frequency in PD probands compared to parental controls. Such regions are termed risk homozygous haplotypes (rHH), which may contain low-frequency recessive variants that contribute to PD risk in a subset of PD patients.

Genetic variations can also be identified using any of a number of methods well known in the art. For example, genetic variations available in public databases, which can be searched using methods and custom algorithms or algorithms known in the art, can be used. In some embodiments, a reference sequence can be from, for example, the human draft genome sequence, publicly available in various databases, or a sequence deposited in a database such as GenBank.

Methods of Detecting CNVs

Detection of genetic variations, specifically CNVs, can be accomplished by one or more suitable techniques described herein. Generally, techniques that can selectively determine whether a particular chromosomal segment is present or absent in an individual can be used for genotyping CNVs. Identification of novel copy number variations can be done by methods for assessing genomic copy number changes.

In some embodiments, methods include but are not limited to, methods that can quantitatively estimate the number of copies of a particular genomic segment, but can also include methods that indicate whether a particular segment is present in a nucleic acid sample or not. In some embodiments, the technique to be used can quantify the amount of segment present, for example, determining whether a DNA segment is deleted, duplicated, or triplicated in subject, for example, Fluorescent In Situ Hybridization (FISH) techniques, and other methods described herein. In some embodiments, methods include detection of copy number variation from array intensity and sequencing read depth using a stepwise Bayesian model (Zhang Z. D., et al. BMC Bioinformatics. 2010 Oct. 31; 11:539). In some embodiments, methods include detecting copy number variations using shotgun sequencing, CNV-seq (Xie C., et al. BMC Bioinformatics. 2009 Mar. 6; 10:80). In some embodiments, methods include analyzing next-generation sequencing (NGS) data for CNV detection using any one of several algorithms developed for each of the four broad methods for CNV detection using NGS, namely the depth of coverage (DOC), read-pair (RP), split-read (SR) and assembly-based (AS) methods. (Teo S. M., et al. Bioinformatics. 2012 Aug. 31). In some embodiments, methods include combining coverage with map information for the identification of deletions and duplications in targeted sequence data (Nord A. S., et al. BMC Genomics. 2011 Apr. 12; 12:184).

In some embodiments, other genotyping technologies can be used for detection of CNVs, including but not limited to, karyotype analysis, Molecular Inversion Probe array technology, for example, Affymetrix SNP Array 6.0, and BeadArray Technologies, for example, Illumina GoldenGate and Infinium assays, as can other platforms such as Nimble-Gen HD2.1 or HD4.2, High-Definition Comparative Genomic Hybridization (CGH) arrays (Agilent Technologies), tiling array technology (Affymetrix), multiplex ligation-dependent probe amplification (MLPA), Invader assay, fluorescence in situ hybridization. and, in one preferred embodiment, Array Comparative Genomic Hybridization (aCGH) methods. As described herein, karyotype analysis can be a method to determine the content and structure of chromosomes in a nucleic acid sample. In some embodiments, karyotyping can be used, in lieu of aCGH, to detect translocations, which can be copy number neutral, and, therefore, not detectable by aCGH. Information about amplitude of particular probes, which can be representative of particular alleles, can provide quantitative dosage information for the particular allele, and by consequence, dosage information about the CNV in question, since the marker can be selected as a marker representative of the CNV and can be located within the CNV. In some embodiments, if the CNV is a deletion, the absence of particular marker allele is representative of the deletion. In some embodiments, if the CNV is a duplication or a higher order copy number variation, the signal intensity representative of the allele correlating with the CNV can represent the copy number. A summary of methodologies commonly used is provided in Perkel (Perkel J. Nature Methods 5:447-453 (2008)).

PCR assays can be utilized to detect CNVs and can provide an alternative to array analysis. In particular, PCR assays can enable detection of precise boundaries of gene/chromosome variants, at the molecular level, and which boundaries are identical in different individuals. PCR assays can be based on the amplification of a junction fragment present only in individuals that carry a deletion. This assay can convert the detection of a loss by array CGH to one of a gain by PCR.

Examples of PCR techniques that can be used in the present disclosure include, but are not limited to quantitative PCR, real-time quantitative PCR (qPCR), quantitative fluorescent PCR (QF-PCR), multiplex fluorescent PCR (MF-PCR), real time PCR(RT-PCR), single cell PCR, PCR-RFLP/RT-PCR-RFLP, hot start PCR and Nested PCR. Other suitable amplification methods include the ligase chain reaction (LCR), ligation mediated PCR (LM-PCR), degenerate oligonucleotide probe PCR (DOP-PCR), transcription amplification, self-sustained sequence replication, selective amplification of target polynucleotide sequences, consensus sequence primed polymerase chain reaction (CP-PCR), arbitrarily primed polymerase chain reaction (AP-PCR) and nucleic acid based sequence amplification (NABSA).

Alternative methods for the simultaneous interrogation of multiple regions include quantitative multiplex PCR of short fluorescent fragments (QMPSF), multiplex amplifiable probe hybridization (MAPH) and multiplex ligation-dependent probe amplification (MLPA), in which copy-number differences for up to 40 regions can be scored in one experiment. Another approach can be to specifically target regions that harbor known segmental duplications, which are often sites of copy-number variation. By targeting the variable nucleotides between two copies of a segmental duplication (called paralogous sequence variants) using a SNP-genotyping method that provides independent fluorescence intensities for the two alleles, it is possible to detect an increase in intensity of one allele compared with the other.

In some embodiments, the amplified piece of DNA can be bound to beads using the sequencing element of the nucleic acid tag under conditions that favor a single amplified piece of DNA molecule to bind a different bead and amplification occurs on each bead. In some embodiments, such amplification can occur by PCR. Each bead can be placed in a separate well, which can be a picoliter-sized well. In some embodiments, each bead is captured within a droplet of a PCR-reaction-mixture-in-oil-emulsion and PCR amplification occurs within each droplet. The amplification on the bead results in each bead carrying at least one million, at least 5 million, or at least 10 million copies of the single amplified piece of DNA molecule.

In embodiments where PCR occurs in oil-emulsion mixtures, the emulsion droplets are broken, the DNA is denatured and the beads carrying single-stranded nucleic acids clones are deposited into a well, such as a picoliter-sized well, for further analysis according to the methods described herein. These amplification methods allow for the analysis of genomic DNA regions. Methods for using bead amplification followed by fiber optics detection are described in Margulies et al. 2005, Nature. 15; 437(7057):376-80, and as well as in US Publication Application Nos. 20020012930; 20030068629; 20030100102; 20030148344; 20040248161; 20050079510, 20050124022; and 20060078909.

Another variation on the array-based approach can be to use the hybridization signal intensities that are obtained from the oligonucleotides employed on Affymetrix SNP arrays or in Illumina Bead Arrays. Here hybridization intensities are compared with average values that are derived from controls, such that deviations from these averages indicate a change in copy number. As well as providing information about copy number, SNP arrays have the added advantage of providing genotype information. For example, they can reveal loss of heterozygosity, which could provide supporting evidence for the presence of a deletion, or might indicate segmental uniparental disomy (which can recapitulate the effects of structural variation in some genomic regions—Prader-Willi and Angelman syndromes, for example).

Many of the basic procedures followed in microarray-based genome profiling are similar, if not identical, to those followed in expression profiling and SNP analysis, including the use of specialized microarray equipment and data-analysis tools. Since microarray-based expression profiling has been well established in the last decade, much can be learned from the technical advances made in this area. Examples of the use of microarrays in nucleic acid analysis that can be used are described in U.S. Pat. Nos. 6,300,063, 5,837,832, 6,969,589, 6,040,138, 6,858,412, U.S. application Ser. No. 08/529,115, U.S. application Ser. No. 10/272, 384, U.S. application Ser. No. 10/045,575, U.S. application Ser. No. 10/264,571 and U.S. application Ser. No. 10/264, 574. It should be noted that there are also distinct differences such as target and probe complexity, stability of DNA over RNA, the presence of repetitive DNA and the need to identify single copy number alterations in genome profiling.

In a preferred embodiment, the genetic variations detected comprise CNVs and can be detected using array CGH. In some embodiments, array CGH can be been implemented using a wide variety of techniques. The initial approaches used arrays produced from large-insert genomic clones such as bacterial artificial chromosomes (BACs). Producing sufficient BAC DNA of adequate purity to make arrays is arduous, so several techniques to amplify small amounts of starting material have been employed. These techniques include ligation-mediated PCR (Snijders et al, Nat. Genet. 29:263-64), degenerate primer PCR using one or several sets of primers, and rolling circle amplification. BAC arrays that provide complete genome tiling paths are also available. Arrays made from less complex nucleic acids such as cDNAs, selected PCR products, and oligonucleotides can also be used. Although most CGH procedures employ hybridization with total genomic DNA, it is possible to use reduced complexity representations of the genome produced by PCR techniques. Computational analysis of the genome sequence can be used to design array elements complementary to the sequences contained in the representation. Various SNP genotyping platforms, some of which use reduced complexity genomic representations, can be useful for their ability to determine both DNA copy number and allelic content across the genome. In some embodiments, small amounts of genomic DNA can be amplified with a variety of whole genome or whole exome amplification methods prior to CGH analysis of the nucleic acid sample. A "whole exome," as used herein, includes s exons throughout the whole genome that are expressed in genes. Since exon selection has tissue and cell type specificity, these positions may be different in the various cell types resulting from a splice variant or alternative splicing. A "whole genome," as used herein, includes the entire genetic code of a genome.

The different basic approaches to array CGH provide different levels of performance, so some are more suitable for particular applications than others. The factors that determine performance include the magnitudes of the copy number changes, their genomic extents, the state and composition of the specimen, how much material is available for analysis, and how the results of the analysis can be used. Many applications use reliable detection of copy number changes of much less than 50%, a more stringent requirement than for other microarray technologies. Note that technical details are extremely important and different implementations of methods using the same array CGH approach can yield different levels of performance. Various CGH methods are known in the art and are equally applicable to one or more methods of the present disclosure. For example, CGH methods are disclosed in U.S. Pat. Nos. 7,030,231; 7,011,949; 7,014,997; 6,977,148; 6,951,761; and 6,916,621, the disclosure from each of which is incorporated by reference herein in its entirety.

The data provided by array CGH are quantitative measures of DNA sequence dosage. Array CGH provides high-resolution estimates of copy number aberrations, and can be performed efficiently on many nucleic acid samples. The advent of array CGH technology makes it possible to monitor DNA copy number changes on a genomic scale and many projects have been launched for studying the genome in specific diseases.

In a preferred embodiment, whole genome array-based comparative genome hybridization (array CGH) analysis, or array CGH on a subset of genomic regions, can be used to efficiently interrogate human genomes for genomic imbalances at multiple loci within a single assay. The development of comparative genomic hybridization (CGH) (Kallioniemi et al, 1992, Science 258: 818-21) provided the first efficient approach to scanning entire genomes for variations in DNA copy number. The importance of normal copy number variation involving large segments of DNA has been unappreciated. Array CGH is a breakthrough technique in human genetics, which is attracting interest from clinicians working in fields as diverse as cancer and IVF (In Vitro Fertilization). The use of CGH microarrays in the clinic holds great promise for identifying regions of genomic imbalance associated with disease. Advances from identifying chromosomal critical regions associated with specific phenotypes to identifying the specific dosage sensitive genes can lead to therapeutic opportunities of benefit to patients. Array CGH is a specific, sensitive and rapid technique that can enable the screening of the whole genome in a single test. It can facilitate and accelerate the screening process in human genetics and is expected to have a profound impact on the screening and counseling of patients with genetic disorders. It is now possible to identify the exact location on the chromosome where an aberration has occurred and it is possible to map these changes directly onto the genomic sequence.

An array CGH approach provides a robust method for carrying out a genome-wide scan to find novel copy number variants (CNVs). The array CGH methods can use labeled fragments from a genome of interest, which can be competitively hybridized with a second differentially labeled genome to arrays that are spotted with cloned DNA fragments, revealing copy-number differences between the two genomes. Genomic clones (for example, BACs), cDNAs, PCR products and oligonucleotides, can all be used as array targets. The use of array CGH with BACs was one of the earliest employed methods and is popular, owing to the extensive coverage of the genome it provides, the availability of reliable mapping data and ready access to clones. The last of these factors is important both for the array experiments themselves, and for confirmatory FISH experiments.

In a typical CGH measurement, total genomic DNA is isolated from control and reference subjects, differentially labeled, and hybridized to a representation of the genome that allows the binding of sequences at different genomic locations to be distinguished. More than two genomes can be compared simultaneously with suitable labels. Hybridization of highly repetitive sequences is typically suppressed by the inclusion of unlabeled Cot-1 DNA in the reaction. In some embodiments of array CGH, it is beneficial to mechanically shear the genomic DNA in a nucleic acid sample, for example, with sonication, prior to its labeling and hybridization step. In another embodiment, array CGH may be performed without use of Cot-1 DNA or a sonication step in the preparation of the genomic DNA in a nucleic acid sample. The relative hybridization intensity of the test and reference signals at a given location can be proportional to the relative copy number of those sequences in the test and reference genomes. If the reference genome is normal then increases and decreases in signal intensity ratios directly indicate DNA copy number variation within the genome of the test cells. Data are typically normalized so that the modal ratio for the genome is set to some standard value, typically 1.0 on a linear scale or 0.0 on a logarithmic scale. Additional measurements such as FISH or flow cytometry can be used to determine the actual copy number associated with a ratio level.

In some embodiments, an array CGH procedure can include the following steps. First, large-insert clones, for example, BACs can be obtained from a supplier of clone libraries. Then, small amounts of clone DNA can be amplified, for example, by degenerate oligonucleotide-primed (DOP)PCR or ligation-mediated PCR in order to obtain sufficient quantities needed for spotting. Next, PCR products can be spotted onto glass slides using, for example, microarray robots equipped with high-precision printing pins. Depending on the number of clones to be spotted and the space available on the microarray slide, clones can either be spotted once per array or in replicate. Repeated spotting of the same clone on an array can increase precision of the measurements if the spot intensities are averaged, and allows for a detailed statistical analysis of the quality of the experiments. Subject and control DNAs can be labeled, for example, with either Cy3 or Cy5-dUTP using random priming and can be subsequently hybridized onto the microarray in a solution containing an excess of Cot1-DNA to block repetitive sequences. Hybridizations can either be performed manually under a coverslip, in a gasket with gentle rocking or, automatically using commercially available hybridization stations. These automated hybridization stations can allow for an active hybridization process, thereby improving the reproducibility as well as reducing the actual hybridization time, which increases throughput. The hybridized DNAs can detected through the two different fluorochromes using standard microarray scanning equipment with either a scanning confocal laser or a charge coupled device (CCD) camera-based reader, followed by spot identification using commercially or freely available software packages.

The use of CGH with arrays that comprise long oligonucleotides (60-100 bp) can improve the detection resolution (in some embodiments, as small as ~3-5 kb sized CNVs on arrays designed for interrogation of human whole genomes) over that achieved using BACs (limited to 50-100 kb or larger sized CNVs due to the large size of BAC clones). In some embodiments, the resolution of oligonucleotide CGH arrays is achieved via in situ synthesis of 1-2 million unique features/probes per microarray, which can include microarrays available from Roche NimbleGen and Agilent Technologies. In addition to array CGH methods for copy number detection, other embodiments for partial or whole genome analysis of CNVs within a genome include, but are not limited to, use of SNP genotyping microarrays and sequencing methods.

Another method for copy number detection that uses oligonucleotides can be representational oligonucleotide microarray analysis (ROMA). It is similar to that applied in the use of BAC and CGH arrays, but to increase the signal-to-noise ratio, the 'complexity' of the input DNA is reduced by a method called representation or whole-genome sampling. Here the DNA that is to be hybridized to the array can be treated by restriction digestion and then ligated to adapters, which results in the PCR-based amplification of fragments in a specific size-range. As a result, the amplified DNA can make up a fraction of the entire genomic sequence—that is, it is a representation of the input DNA that has significantly reduced complexity, which can lead to a reduction in background noise. Other suitable methods available to the skilled person can also be used, and are within scope of the present disclosure.

A comparison of one or more genomes relative to one or more other genomes with array CGH, or a variety of other CNV detection methods, can reveal the set of CNVs between two genomes, between one genome in comparison to multiple genomes, or between one set of genomes in comparison to another set of genomes. In some embodiments, an array CGH experiment can be performed by hybrizing a single test genome against a pooled nucleic acid sample of two or more genomes, which can result in minimizing the detection of higher frequency variants in the experiment. In some embodiments, a test genome can be hybridized alone (i.e., one-color detection) to a microarray, for example, using array CGH or SNP genotyping methods, and the comparison step to one or more reference genomes can be performed in silico to reveal the set of CNVs in the test genome relative to the one or more reference genomes. In one preferred embodiment, a single test genome is compared to a single reference genome in a 2-color experiment wherein both genomes are cohybridized to the microarray.

Array CGH can be used to identify genes that are causative or associated with a particular phenotype, condition, or disease by comparing the set of CNVs found in the affected cohort to the set of CNVs found in an unaffected cohort. An unaffected cohort may consist of any individual unaffected by the phenotype, condition, or disease of interest, but in one preferred embodiment is comprised of individuals or subjects that are apparently healthy (normal). Methods employed for such analyses are described in U.S. Pat. Nos. 7,702,468 and 7,957,913. In some embodiments of CNV comparison methods, candidate genes that are causative or associated (i.e., potentially serving as a biomarker) with a phenotype, condition, or disease will be identified by CNVs that occur in the affected cohort but not in the unaffected cohort. In some embodiments of CNV comparison methods, candidate genes that are causative or associated (i.e., potentially serving as a biomarker) with a phenotype, condition, or disease will be identified by CNVs that occur at a statistically significant higher frequency in the affected cohort as compared their frequency in the unaffected cohort. Thus, CNVs preferentially detected in the affected cohort as compared to the unaffected cohort can serve as beacons of genes that are causative or associated with a particular phenotype, condition, or disease. In some embodiments, CNV detection and comparison methods can result in direct identification of the gene that is causative or associated with phenotype, condition, or disease if the CNVs are found to overlap with or encompass the gene(s). In some embodiments, CNV detection and comparison methods can result in identification of regulatory regions of the genome (e.g., promoters, enhancers, transcription factor binding sites) that regulate the expression of one or more genes that are causative or associated with the phenotype, condition, or disease of interest.

Due to the large amount of genetic variation between any two genomes, or two sets (cohorts) of genomes, being compared, one preferred embodiment is to reduce the genetic variation search space by interrogating only CNVs, as opposed to the full set of genetic variants that can be identified in an individual's genome or exome. The set of CNVs that occur only, or at a statistically higher frequency, in the affected cohort as compared to the unaffected cohort can then be further investigated in targeted sequencing experiments to reveal the full set of genetic variants (of any size or type) that are causative or associated (i.e., potentially serving as a biomarker) with a phenotype, condition, or disease. It can be appreciated to those skilled in the art that the targeted sequencing experiments are performed in both the affected and unaffected cohorts in order to identify the genetic variants (e.g., SNVs and indels) that occur only, or at a statistically significant higher frequency, in the affected individual or cohort as compared to the unaffected cohort.

When investigating a particular phenotype, condition, or disease, such as PD, it can be appreciated by those skilled in the art that the number of PD candidate genes (or regulatory sequences) identified via CNV (or other variant types) detection methods may increase or decrease when additional PD cohorts are analyzed. Similarly, the number of PD candidate genes (or regulatory sequences), for example, identified via CNV (or other variant types) detection methods may increase or decrease when additional unaffected cohorts are used to interpret the affected cohort CNVs (or other variant types). For very rare CNVs (e.g., <0.1% frequency in the general population), only a single case may be observed in a given PD cohort (e.g., 100 cases) but further statistical significance or evidence for the gene (or regulatory sequence/locus in the genome) can be established by: 1) CNV analysis of additional PD cohorts, 2) CNV analysis of additional Normal cohorts, 3) targeted gene sequencing of both PD and Normal cohorts, and/or 4) functional characterization of the PD candidate gene (e.g., in silico analysis of the predicted impact of the candidate mutation on the gene product, RNAi knockdown experiments, biochemical assays on PD patient tissue, gene expression analysis of disease-relevant tissues or of induced pluripotent stem cells (iPSCs) created from the PD patient(s) harboring the candidate PD-causing genetic variant).

It can be appreciated by those skilled in the art that a candidate gene may validate as causative of the phenotype, condition, or disease (e.g., PD), which may, for example, be confirmed via mechanism of action experiments, or it may serve as a biomarker of the phenotype, condition, or disease. Thus, in the example of PD, in some embodiments, the PD-specific gene (or regulatory sequence/locus) may be a biomarker of age-of-onset for PD and disease severity, and thus have diagnostic utility for monitoring patients known to be at risk for PD or as a general screening test in the population for early diagnosis of the disease. In some embodiments, the PD-specific gene/biomarker may be an indicator of drug response (e.g., a particular subtype of PD may respond best to a therapeutic targeting a particular phenotype, causative gene, or other gene in the same pathway as the causative gene) and thus have utility during drug development in clinical trials. For example, clinical trials for a therapeutic that targets a PD genetic subtype comprising only 10% of all patients exhibiting symptoms of PD, can be designed to comprise only those 10% of patients with a specific genotype(s) in order to reduce the time and cost of such clinical trials (e.g., smaller number of patients in the clinical trial). It can be appreciated by those skilled in the art that such patient stratification methods (i.e., specific genotypes correlated with the disease or drug response) can be employed not only for targeted therapeutics, but in general for any drug that is approved or in development (i.e., the mechanism of action may or may not be known). For example, drugs in development or approved to treat, for example, cancer, may have utility in being repurposed to treat PD. Such patient stratification methods can also be utilized to develop a companion diagnostic test (e.g., comprising the specific genes/genotypes found in patients that are indicative of drug response) for a particular drug, either concurrently during the clinical trials for the drug or after drug approval (e.g., as a new indication or for the physician to use in guiding medical decisions for the patient).

Further neurological and/or links to PD pathology can be established via pathway analysis of the genes, which may take into consideration binding interactions (e.g., via yeast 2-hybrid screen) and molecular events (e.g., kinase activity or other enzymatic processes) if such information is available for the gene(s) of interest (i.e., specified in the analysis). Both commercial (e.g., Ingenuity's IPA software and Thomson Reuter's GeneGo software) and open source software (e.g., String: string-db.org/) are available for such analyses. To assess connections to established PD biology, analyses can be performed for the set of candidate PD genes independently or against known causative PD genes (GBA, LRRK2, PARK2, PARK7, PINK1, SNCA, VPS35) singly or as a group. In some embodiments, PD candidate genes can be distributed into 5 main categories: 1) neurotrophin gene product or gene candidate impacts a neurotrophin, 2) polypeptide misfolding, aggregation, and/or role in ubiquitin pathway, 3) genes linked to a known causative PD gene (e.g., binding partner), or a novel gene family member of a known PD gene, 4) genes linked to PD pathology by function (e.g., mitochondrial dysfunction, oxidative stress, or PD phenotypes such as dopaminergic neuronal loss), and 5) other (e.g., established role in other diseases with no obvious neurological biology, such as cancer) or unknown gene function (e.g., limited or no gene information presently annotated for the PD-specific gene).

A method of screening a subject for a disease or disorder can comprise assaying a nucleic acid sample from the subject to detect sequence information for more than one genetic locus and comparing the sequence information to a panel of nucleic acid biomarkers and screening the subject for the presence or absence of the disease or disorder if one or more of low frequency biomarkers in the panel are present in the sequence information.

The panel can comprise at least one nucleic acid biomarker for each of the more than one genetic loci. For example, the panel can comprise 2, 3, 4, 5, 6, 7, 8, 9, 10, 11, 12, 3, 14, 15, 15, 17, 18, 19, 20, 25, 30, 35, 40, 45, 50, 75, 100, 150, 200 or more nucleic acid biomarkers for each of the more than one genetic loci. In some embodiments, the panel can comprise from about 2-1000 nucleic acid biomarkers. For example, the panel can comprise from about 2-900, 2-800, 2-700, 2-600, 2-500, 2-400, 2-300, 2-200, 2-100, 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000 nucleic acid biomarkers.

The panel can comprise at least 2 low frequency biomarkers. For example, the panel can comprise at least 2, 3, 4, 5, 6, 7, 8, 9, 10, 11, 12, 3, 14, 15, 15, 17, 18, 19, 20, 25, 30, 35, 40, 45, 50, 55, 60, 65, 70, 75, 80, 85, 90, 95, 100, 125, 150, 175, 200, 250, 500, or 1000 or more low frequency biomarkers. In some embodiments, the panel can comprise from about 2-1000 low frequency biomarkers. For example, the panel can comprise from about 2-900, 2-800, 2-700, 2-600, 2-500, 2-400, 2-300, 2-200, 2-100, 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000 1000 low frequency biomarkers. In some embodiments, a low frequency biomarker can occur at a frequency of 0.1% or less in a population of subjects without a diagnosis of the disease or disorder. For example, a low frequency biomarker can occur at a frequency of 0.05%, 0.01%, 0.005%, 0.001%, 0.0005%, 0.0001%, 0.00005%, or 0.00001% or less in a population of subjects without a diagnosis of the disease or disorder. In some embodiments, a low frequency biomarker can occur at a frequency from about 0.00001%-0.1% in a population of subjects without a diagnosis of the disease or disorder. For example, a low frequency biomarker can occur at a frequency of from about 0.00001%-0.00005%, 0.00001%-0.0001%, 0.00001%-0.0005%, 0.00001%-0.001%, 0.00001%-0.005%, 0.00001%-0.01%, 0.00001%-0.05%, 0.00005%-0.0001%, 0.00005%-0.0005%, 0.00005%-0.001%, 0.00005%-0.005%, 0.00005%-0.01%, 0.00005%-0.05%, 0.00005%-0.1%, 0.0001%-0.0005%, 0.0001%-0.001%, 0.0001%-0.005%, 0.0001%-0.01%, 0.0001%-0.05%, 0.0001%-0.1%, 0.0005%-0.001%, 0.0005%-0.005%, 0.0005%-0.01%, 0.0005%-0.05%, 0.0005%-0.1%, 0.001%-0.005%, 0.001%-0.01%, 0.001%-0.05%, 0.001%-0.1%, 0.005%-0.01%, 0.005%-0.05%, 0.005%-0.1%, 0.01%-0.05%, 0.01%-0.1%, or 0.05%-0.1% in a population of subjects without a diagnosis of the disease or disorder In some embodiments, the presence or absence of the disease or disorder in the subject can be determined with at least 50% confidence. For example, the presence or absence of the disease or disorder in the subject can be determined with at least 50%, 55%, 60%, 65%, 70%, 75%, 80%, 85%, 90%, 95%, 98%, 99%, or 100% confidence. In some embodiments, the presence or absence of the disease or disorder in the subject can be determined with a 50%-100% confidence. For example, the presence or absence of the disease or disorder in the subject can be determined with a 60%-100%, 70%-100%, 80%-100%, 90%-100%, 50%-90%, 50%-80%, 50%-70%, 50%-60%, 60%-90%, 60%-80%, 60%-70%, 70%-90%, 70%-80%, or 80%-90%. In one embodiment, PD candidate CNVs and genes or regulatory loci associated with these CNVs can be determined or identified by comparing genetic data from a cohort of normal individuals to that of an individual or a cohort of individuals known to have, or be susceptible to a developmental disorder such as PD.

In one embodiment, PD candidate CNV-subregions and genes associated with these regions can be determined or identified by comparing genetic data from a cohort of normal individuals (NVE) to that of a cohort of individual known to have, or be susceptible to PD.

In some embodiments, a nucleic acid sample from one individual or nucleic acid samples from a pool of 2 or more individuals without PD can serve as the reference nucleic acid sample(s) and the nucleic acid sample from an individual known to have PD or being tested to determine if they have PD can serve as the test nucleic acid sample. In one preferred embodiment, the reference and test nucleic acid samples are sex-matched and co-hybridized on the CGH array. For example, reference nucleic acid samples can be labeled with a fluorophore such as Cy5, using methods described herein, and test subject nucleic acid samples can be labeled with a different fluorophore, such as Cy3. After labeling, nucleic acid samples can be combined and can be co-hybridized to a microarray and analyzed using any of the methods described herein, such as aCGH. Arrays can then be scanned and the data can be analyzed with software. Genetic alterations, such as CNVs, can be called using any of the methods described herein. A list of the genetic alterations, such as CNVs, can be generated for one or more test subjects and/or for one or more reference subjects. Such lists of CNVs can be used to generate a master list of non-redundant CNVs and/or CNV-subregions for each type of cohort. In one embodiment, a cohort of test nucleic acid samples, such as individuals known to have or suspected to have PD, can be cohybridized with an identical sex-matched reference individual or sex-matched pool of reference individuals to generate a list of redundant or non-redundant CNVs. Such lists can be based on the presence or absence of one or more CNVs and/or CNV subregions present in individuals within the cohort. In this manner, a master list can contain a number of distinct CNVs and/or CNV-subregions, some of which are uniquely present in a single individual and some of which are present in multiple individuals.

In some embodiments, CNVs and/or CNV-subregions of interest can be obtained by annotation of each CNV and/or CNV-subregion with relevant information, such as overlap with known genes and/or exons exons or intergenic regulatory regions such as transcription factor binding sites. In some embodiments, CNVs and/or CNV-subregions of interest can be obtained by calculating the OR for a CNV and/or CNV-subregion according to the following formula: OR= (PD/((# individuals in PD cohort)−PD))/(Normal/((# individuals in Normal cohort)−Normal)), where: PD=number of PD individuals with a CNV-subregion of interest and Normal=number of Normal individuals with the CNV and/or CNV-subregion of interest. If Normal=0, it can be set to 1 to avoid dealing with infinities in cases where no CNVs are seen in the Normal cohort. In some embodiments, a set of publicly available CNVs (e.g., the Database of Genomic Variants, http://projects.tcag.ca/variation/) can be used as the Normal cohort for comparison to the affected cohort CNVs. In another embodiment, the set of Normal cohort CNVs may comprise a private database generated by the same CNV detection method, such as array CGH, or by a plurality of CNV detection methods that include, but are not limited to, array CGH, SNP genotyping arrays, custom CGH arrays, custom genotyping arrays, exome sequencing, whole genome sequencing, targeted sequencing, FISH, q-PCR, or MLPA.

The number of individuals in any given cohort can be at least about 10, 50, 100, 200, 300, 400, 500, 600, 700, 800, 900, 1000, 2500, 5000, 7500, 10,000, 100,000, or more. In some embodiments, the number of individuals in any given cohort can be from 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000.

In some embodiments, a CNV-subregion/gene can be of interest if the CNV-subregion overlaps a known gene, and is associated with an OR of at least 6. For example, a CNV-subregion/gene can be of interest if the CNV-subregion overlaps a known gene, and is associated with an OR of at least 7, 8, 9, 10, 12, 14, 16, 18, 20, 25, 30, 35, 40, 45, 50, or more. In some embodiments, a CNV-subregion/gene can be of interest if the CNV-subregion overlaps a known gene, and is associated with an OR from about 6-100, 6-50, 6-40, 6-30, 6-20, 6-10, 6-9, 6-8, 6-7, 8-100, 8-50. 8-40, 8-30, 8-20, 8-10, 10-100, 10-50, 10-40, 10-30, 10-20, 20-100, 20-50, 20-40, 20-30, 30-100, 30-50, 30-40, 40-100, 40-50, 50-100, or 5-7. The CNV-subregion/gene can be an exonic or intronic part of the gene, or both.

In some embodiments, a CNV-subregion/gene can be of interest if the CNV-subregion does not overlap a known gene (e.g., is non-genic or intergenic) and is associated with an OR of at least 10. For example, a CNV-subregion/gene can be of interest if the CNV-subregion does not overlap a known gene (e.g., is non-genic or intergenic) and is associated with an OR of at least 12, 14, 16, 18, 20, 25, 30, 35, 40, 45, 50, or more. In some embodiments, a CNV-subregion/gene can be of interest if the CNV-subregion does not overlap a known gene (e.g., is non-genic or intergenic) and is associated with an OR from about 10-100, 10-50, 10-40, 10-30, 10-20, 20-100, 20-50, 20-40, 20-30, 30-100, 30-50, 30-40, 40-100, 40-50, 50-100, or 9-11.

In some embodiments, a CNV-subregion/gene can be of interest if the OR associated with the sum of PD cases and the sum of NVE cases affecting the same gene (including distinct CNV-subregions) is at least 6. For example, a CNV-subregion/gene can be of interest if the OR associated with the sum of PD cases and the sum of NVE cases affecting the same gene (including distinct CNV-subregions) is at least 7, 8, 9, 10, 12, 14, 16, 18, 20, 25, 30, 35, 40, 45, 50, or more. In some embodiments, a CNV-subregion/gene can be of interest if the OR associated with the sum of PD cases and the sum of NVE cases affecting the same gene (including distinct CNV-subregions) is from about 6-100, 6-50, 6-40, 6-30, 6-20, 6-10, 6-9, 6-8, 6-7, 8-100, 8-50. 8-40, 8-30, 8-20, 8-10, 10-100, 10-50, 10-40, 10-30, 10-20, 20-100, 20-50, 20-40, 20-30, 30-100, 30-50, 30-40, 40-100, 40-50, 50-100, or 5-7.

In some embodiments, a CNV-subregion/gene can be of interest if the CNV-subregion overlaps a known gene, and is associated with an OR of at least 10. In some embodiments, a CNV-subregion/gene can be of interest if the CNV-subregion overlaps a known gene, is associated with an OR of at least 6, and if the OR associated with the sum of PD cases and the sum of NVE cases affecting the same gene (including distinct CNV-subregions) is at least 6.

The data presented in Tables 1 and 2 was generated on the basis of a comparison of copy number variants (CNVs) identified in a PD cohort. CNV genome locations are provided using the Human March 2006 (NCBI36/hg18) assembly. It can be appreciated by those skilled in the art that a CNV found in an affected individual may have one or more subregions that are preferentially found in the affected cohort as compared to the unaffected cohort and, similarly, other subregions within the CNV that are found at comparable frequencies, or not statistically significant different frequencies, in the affected and unaffected cohorts. In a preferred embodiment, CNV detection and analysis methods are employed that enable comparison of CNV subregions to facilitate identification of genes (or regulatory loci) that are causative or associated with the phenotype, condition, or disease being investigated (or detected for diagnostic purposes). In Table 1, SEQ IDs 1-382 refer to the CNV nucleotide sequences (full nucleotide sequence obtained for the original CNV). In Table 4, SEQ IDs 383-1020 refer to the genomic nucleotide sequences over which the RNA transcripts extend (full genomic extent of the transcript nucleotide sequences, not just the short nucleotide sequence associated with the mRNA).

Table 1 lists all CNVs of interest, obtained as described in the text, with the exception that, for each entry, the chromosome and original CNV start and stop positions are listed, along with original CNV size, type (loss or gain), PD case ID, gene annotation (for the CNV-subregion, not the original CNV), and whether or not the CNV overlaps an exon (for the CNV-subregion not the original CNV). All CNVs have been prioritized according to significance of genes, with Priority Number=1 being highest priority. In addition, the column 'SEQ ID No' lists the SEQ IDs of the sequences being submitted (SEQ IDs 1-382 are for the original CNVs described in Table 1). Note that for some CNVs that are identical between different individuals, the priority numbers (and SEQ IDs) are identical. In other words, the sequence for a given CNV is only included once, if identical in different individuals. For example, rows 1-2 of Table 1 refer to identical CNVs in 2 cases (PD Case IDs 1004, 1010).

Table 2 is identical to Table 1, with some exceptions. The CNV coordinates listed refer to the actual CNV-subregions of interest found in the PD cohort, as opposed to Table 1, which lists the original CNVs. In addition, the 'PD Case ID' column lists all PD individuals who share the same CNV-subregion.

Table 3 represents a non-redundant list for all genes listed in Table 2 (namely, those relevant to CNV-subregions of interest), and includes RefSeq Gene Symbol; CNV Gene Region (whether intronic, exonic or both); NCBI Gene ID (DNA Accession number); Gene Biology Curation (brief gene description); and Gene Annotation (Summary of gene function).

Table 4 represents a non-redundant list for all genes listed in Table 2 (namely, those relevant to CNV-subregions of interest) and includes RefSeq Gene Symbol; CNV Gene Region (whether intronic, exonic or both); SEQ ID No (numbered consecutively from Table 3, SEQ IDs 383-1020 refer to the transcript sequences); RefSeq Accession Number (ay be multiple entries per gene, hence Table 4 has more entries than Table 3); RefSeq Gene Description (brief description of mRNA).

More than one RNA product (e.g., alternatively spliced mRNA transcripts and non-coding RNAs) can be produced from a single gene. Table 4 lists all presently known transcript variants (and their RNA accession numbers) but new variants may be found when further studies are completed and that generation of these additional transcript variants (and ultimately polypeptide and/or regulatory RNA products) may also be impacted by one or more CNVs or CNV subregions listed in Tables 1 and 2, respectively. The transcripts listed in Table 4 can be expression products of the same gene biomarker. The gene biomarker can comprise genomic DNA encoding the gene, including exons, introns, and/or regulatory binding regions (such as enhancers, promoters, silencers, and/or response elements). Point mutations, polymorphisms, translocations, insertions, deletions, amplifications, inversions, microsatellites, interstitial deletions, CNVs, loss of heterozygosity, or any other aberrations which affect the structure or function of one or more gene biomarkers and/or expression products thereof, can be associated with a neurological disorder as described herein.

TABLE 1

| Priority Number | Seq ID | Chr | Start | Stop | Size | CNV Type | PD Case ID | RefSeq Gene Symbol | Exon overlap |
|---|---|---|---|---|---|---|---|---|---|
| 1 | 1 | 10 | 117224281 | 117232646 | 8365 | gain | 1004 | ATRNL1 | N |
| 1 | 1 | 10 | 117224281 | 117232646 | 8365 | gain | 1010 | ATRNL1 | N |
| 2 | 2 | 10 | 117331013 | 117339297 | 8284 | loss | 2337 | ATRNL1 | N |
| 2 | 2 | 10 | 117331013 | 117339297 | 8284 | loss | 2614 | ATRNL1 | N |
| 3 | 3 | 10 | 117338366 | 117339297 | 931 | loss | 2294 | ATRNL1 | N |
| 3 | 3 | 10 | 117338366 | 117339297 | 931 | loss | 2332 | ATRNL1 | N |
| 3 | 3 | 10 | 117338366 | 117339297 | 931 | loss | 2404 | ATRNL1 | N |
| 3 | 3 | 10 | 117338366 | 117339297 | 931 | loss | 2405 | ATRNL1 | N |
| 3 | 3 | 10 | 117338366 | 117339297 | 931 | loss | 2447 | ATRNL1 | N |
| 3 | 3 | 10 | 117338366 | 117339297 | 931 | loss | 2481 | ATRNL1 | N |
| 3 | 3 | 10 | 117338366 | 117339297 | 931 | loss | 2610 | ATRNL1 | N |
| 3 | 3 | 10 | 117338366 | 117339297 | 931 | loss | 2628 | ATRNL1 | N |
| 4 | 4 | 7 | 146842506 | 146844392 | 1886 | gain | 2306 | CNTNAP2 | N |
| 4 | 4 | 7 | 146842506 | 146844392 | 1886 | gain | 2408 | CNTNAP2 | N |
| 4 | 4 | 7 | 146842506 | 146844392 | 1886 | gain | 2608 | CNTNAP2 | N |
| 5 | 5 | 7 | 147697712 | 147710037 | 12325 | gain | 1017 | CNTNAP2 | N |
| 6 | 6 | 7 | 147704200 | 147710037 | 5837 | gain | 1018 | CNTNAP2 | N |
| 7 | 7 | 7 | 147707161 | 147710037 | 2876 | gain | 994 | CNTNAP2 | N |
| 8 | 8 | 7 | 147441927 | 147443119 | 1192 | loss | 2266 | MIR548T, CNTNAP2 | N |
| 8 | 8 | 7 | 147441927 | 147443119 | 1192 | loss | 2269 | MIR548T, CNTNAP2 | N |
| 8 | 8 | 7 | 147441927 | 147443119 | 1192 | loss | 2320 | MIR548T, CNTNAP2 | N |
| 8 | 8 | 7 | 147441927 | 147443119 | 1192 | loss | 2436 | MIR548T, CNTNAP2 | N |
| 8 | 8 | 7 | 147441927 | 147443119 | 1192 | loss | 2443 | MIR548T, CNTNAP2 | N |
| 8 | 8 | 7 | 147441927 | 147443119 | 1192 | loss | 2565 | MIR548T, CNTNAP2 | N |
| 8 | 8 | 7 | 147441927 | 147443119 | 1192 | loss | 2593 | MIR548T, CNTNAP2 | N |
| 9 | 9 | 2 | 112750646 | 112764889 | 14243 | loss | 996 | ZC3H6 | N |
| 9 | 9 | 2 | 112750646 | 112764889 | 14243 | loss | 1022 | ZC3H6 | N |
| 9 | 9 | 2 | 112750646 | 112764889 | 14243 | loss | 2327 | ZC3H6 | N |
| 9 | 9 | 2 | 112750646 | 112764889 | 14243 | gain | 2515 | ZC3H6 | N |
| 10 | 10 | 2 | 112752277 | 112764889 | 12612 | loss | 2342 | ZC3H6 | N |
| 10 | 10 | 2 | 112752277 | 112764889 | 12612 | loss | 2360 | ZC3H6 | N |
| 10 | 10 | 2 | 112752277 | 112764889 | 12612 | loss | 2426 | ZC3H6 | N |
| 10 | 10 | 2 | 112752277 | 112764889 | 12612 | loss | 2587 | ZC3H6 | N |
| 11 | 11 | 18 | 48127523 | 48131320 | 3797 | loss | 999 | DCC | N |
| 12 | 12 | 18 | 48539033 | 48541815 | 2782 | gain | 1013 | DCC | N |
| 13 | 13 | 18 | 48616189 | 48620934 | 4745 | loss | 2054 | DCC | N |
| 13 | 13 | 18 | 48616189 | 48620934 | 4745 | loss | 2265 | DCC | N |
| 13 | 13 | 18 | 48616189 | 48620934 | 4745 | loss | 2412 | DCC | N |

TABLE 1-continued

| Priority Number | Seq ID | Chr | Start | Stop | Size | CNV Type | PD Case ID | RefSeq Gene Symbol | Exon overlap |
|---|---|---|---|---|---|---|---|---|---|
| 13 | 13 | 18 | 48616189 | 48620934 | 4745 | loss | 2428 | DCC | N |
| 13 | 13 | 18 | 48616189 | 48620934 | 4745 | loss | 2615 | DCC | N |
| 14 | 14 | 20 | 20043913 | 20061778 | 17865 | gain | 947 | C20orf26 | N |
| 14 | 14 | 20 | 20043913 | 20061778 | 17865 | gain | 960 | C20orf26 | N |
| 15 | 15 | 20 | 20043913 | 20061717 | 17804 | gain | 964 | C20orf26 | N |
| 16 | 16 | 20 | 19971492 | 19982732 | 11240 | gain | 2190 | C20orf26, CRNKL1 | Y |
| 16 | 16 | 20 | 19971492 | 19982732 | 11240 | gain | 2474 | C20orf26, CRNKL1 | Y |
| 16 | 16 | 20 | 19971492 | 19982732 | 11240 | gain | 2489 | C20orf26, CRNKL1 | Y |
| 17 | 17 | 20 | 19979618 | 19981548 | 1930 | loss | 2597 | C20orf26, CRNKL1 | Y |
| 18 | 18 | 3 | 193371224 | 193374127 | 2903 | gain | 1016 | FGF12 | N |
| 19 | 19 | 3 | 193472185 | 193478807 | 6622 | gain | 2053 | FGF12 | N |
| 19 | 19 | 3 | 193472185 | 193478807 | 6622 | gain | 2418 | FGF12 | N |
| 19 | 19 | 3 | 193472185 | 193478807 | 6622 | gain | 2427 | FGF12 | N |
| 19 | 19 | 3 | 193472185 | 193478807 | 6622 | gain | 2450 | FGF12 | N |
| 20 | 20 | 3 | 193678496 | 193680012 | 1516 | loss | 1029 | FGF12 | N |
| 21 | 21 | 3 | 193785530 | 193794411 | 8881 | gain | 1030 | FGF12 | N |
| 22 | 22 | 3 | 193787655 | 193797190 | 9535 | gain | 947 | FGF12 | N |
| 22 | 22 | 3 | 193787655 | 193797190 | 9535 | gain | 959 | FGF12 | N |
| 23 | 23 | 5 | 44280749 | 44389035 | 108286 | gain | 966 | FGF10 | Y |
| 24 | 24 | 1 | 74271266 | 74334696 | 63430 | loss | 2544 | LRRIQ3 | Y |
| 25 | 25 | 1 | 74359462 | 74372201 | 12739 | gain | 2222 | LRRIQ3 | N |
| 26 | 26 | 1 | 74361348 | 74372201 | 10853 | loss | 968 | LRRIQ3 | N |
| 26 | 26 | 1 | 74361348 | 74372201 | 10853 | loss | 1010 | LRRIQ3 | N |
| 26 | 26 | 1 | 74361348 | 74372201 | 10853 | loss | 1029 | LRRIQ3 | N |
| 27 | 27 | 1 | 74421868 | 74434506 | 12638 | gain | 2539 | LRRIQ3 | Y |
| 27 | 27 | 1 | 74421868 | 74434506 | 12638 | gain | 2610 | LRRIQ3 | Y |
| 28 | 28 | 3 | 198119175 | 198124199 | 5024 | gain | 2322 | SENP5 | N |
| 28 | 28 | 3 | 198119175 | 198124199 | 5024 | gain | 2345 | SENP5 | N |
| 28 | 28 | 3 | 198119175 | 198124199 | 5024 | gain | 2366 | SENP5 | N |
| 28 | 28 | 3 | 198119175 | 198124199 | 5024 | gain | 2427 | SENP5 | N |
| 29 | 29 | 3 | 198027242 | 198132696 | 105454 | loss | 948 | SENP5, PAK2 | Y |
| 29 | 29 | 3 | 198027242 | 198132696 | 105454 | loss | 950 | SENP5, PAK2 | Y |
| 29 | 29 | 3 | 198027242 | 198132696 | 105454 | loss | 1020 | SENP5, PAK2 | Y |
| 29 | 29 | 3 | 198027242 | 198132696 | 105454 | loss | 1034 | SENP5, PAK2 | Y |
| 30 | 30 | 3 | 198036999 | 198125625 | 88626 | loss | 951 | SENP5, PAK2 | Y |
| 31 | 31 | 3 | 30711659 | 30807514 | 95855 | gain | 2613 | GADL1 | Y |
| 32 | 32 | 3 | 30739769 | 30751038 | 11269 | loss | 1017 | GADL1 | Y |
| 33 | 33 | 3 | 30739769 | 30748426 | 8657 | loss | 1025 | GADL1 | Y |
| 34 | 34 | 3 | 30743173 | 30748426 | 5253 | loss | 978 | GADL1 | Y |
| 35 | 35 | 3 | 30768468 | 30770607 | 2139 | gain | 2577 | GADL1 | N |
| 36 | 36 | 3 | 30845814 | 30896445 | 50631 | loss | 2603 | GADL1 | Y |
| 37 | 37 | 12 | 85111072 | 85124672 | 13600 | gain | 2261 | MGAT4C | N |
| 37 | 37 | 12 | 85111072 | 85124672 | 13600 | gain | 2425 | MGAT4C | N |
| 38 | 38 | 12 | 85113258 | 85124672 | 11414 | gain | 2338 | MGAT4C | N |
| 39 | 39 | 12 | 85411806 | 85413202 | 1396 | gain | 1027 | MGAT4C | N |
| 40 | 40 | 12 | 85544596 | 85550905 | 6309 | gain | 976 | MGAT4C | N |
| 40 | 40 | 12 | 85544596 | 85550905 | 6309 | gain | 978 | MGAT4C | N |
| 41 | 41 | 12 | 85681656 | 85687967 | 6311 | loss | 948 | MGAT4C | N |
| 41 | 41 | 12 | 85681656 | 85687967 | 6311 | loss | 971 | MGAT4C | N |
| 41 | 41 | 12 | 85681656 | 85687967 | 6311 | loss | 989 | MGAT4C | N |
| 42 | 42 | 2 | 198497294 | 198505239 | 7945 | loss | 2190 | PLCL1 | N |
| 42 | 42 | 2 | 198497294 | 198505239 | 7945 | loss | 2298 | PLCL1 | N |
| 42 | 42 | 2 | 198497294 | 198505239 | 7945 | loss | 2575 | PLCL1 | N |
| 43 | 43 | 6 | 151310683 | 151318805 | 8122 | gain | 992 | MTHFD1L | Y |
| 44 | 44 | 6 | 151312868 | 151318805 | 5937 | gain | 1013 | MTHFD1L | Y |
| 45 | 45 | 6 | 151312868 | 151320671 | 7803 | gain | 2342 | MTHFD1L | Y |
| 46 | 46 | 6 | 151312868 | 151317012 | 4144 | gain | 2583 | MTHFD1L | N |
| 46 | 46 | 6 | 151312868 | 151317012 | 4144 | gain | 2631 | MTHFD1L | N |
| 47 | 47 | 6 | 18532373 | 18537857 | 5484 | gain | 2372 | RNF144B | Y |
| 47 | 47 | 6 | 18532373 | 18537857 | 5484 | gain | 2620 | RNF144B | Y |
| 47 | 47 | 6 | 18532373 | 18537857 | 5484 | gain | 2629 | RNF144B | Y |
| 48 | 48 | 6 | 18574467 | 18576632 | 2165 | loss | 1024 | RNF144B | Y |
| 49 | 49 | 5 | 127434789 | 127443917 | 9128 | gain | 1029 | FLJ33630 | N |
| 50 | 50 | 5 | 127434789 | 127436376 | 1587 | gain | 2315 | FLJ33630 | N |
| 50 | 50 | 5 | 127434789 | 127436376 | 1587 | gain | 2350 | FLJ33630 | N |
| 50 | 50 | 5 | 127434789 | 127436376 | 1587 | gain | 2563 | FLJ33630 | N |
| 51 | 51 | 5 | 127436376 | 127439603 | 3227 | gain | 990 | FLJ33630 | N |
| 52 | 52 | 7 | 153645525 | 153647352 | 1827 | loss | 2050 | DPP6 | N |
| 52 | 52 | 7 | 153645525 | 153647352 | 1827 | loss | 2461 | DPP6 | N |
| 52 | 52 | 7 | 153645525 | 153647352 | 1827 | loss | 2521 | DPP6 | N |
| 53 | 53 | 7 | 153901057 | 154002117 | 101060 | loss | 957 | DPP6 | N |
| 54 | 54 | 7 | 154028650 | 154032130 | 3480 | loss | 969 | DPP6 | N |
| 54 | 54 | 7 | 154028650 | 154032130 | 3480 | loss | 993 | DPP6 | N |
| 54 | 54 | 7 | 154028650 | 154032130 | 3480 | gain | 1031 | DPP6 | N |
| 55 | 55 | 12 | 55879318 | 55922237 | 42919 | gain | 961 | NDUFA4L2, LRP1, SHMT2, NXPH4 | Y |

TABLE 1-continued

| Priority Number | Seq ID | Chr | Start | Stop | Size | CNV Type | PD Case ID | RefSeq Gene Symbol | Exon overlap |
|---|---|---|---|---|---|---|---|---|---|
| 55 | 55 | 12 | 55879318 | 55922237 | 42919 | gain | 984 | NDUFA4L2, LRP1, SHMT2, NXPH4 | Y |
| 56 | 56 | 12 | 55880398 | 55922237 | 41839 | gain | 967 | NDUFA4L2, LRP1, SHMT2, NXPH4 | Y |
| 57 | 57 | 12 | 130944468 | 130946248 | 1780 | loss | 995 | ULK1 | Y |
| 57 | 57 | 12 | 130944468 | 130946248 | 1780 | loss | 998 | ULK1 | Y |
| 57 | 57 | 12 | 130944468 | 130946248 | 1780 | gain | 1005 | ULK1 | Y |
| 57 | 57 | 12 | 130944468 | 130946248 | 1780 | loss | 1009 | ULK1 | Y |
| 57 | 57 | 12 | 130944468 | 130946248 | 1780 | loss | 1031 | ULK1 | Y |
| 57 | 57 | 12 | 130944468 | 130946248 | 1780 | gain | 1033 | ULK1 | Y |
| 57 | 57 | 12 | 130944468 | 130946248 | 1780 | gain | 1035 | ULK1 | Y |
| 58 | 58 | 22 | 22721042 | 22735036 | 13994 | loss | 955 | GSTTP2 | Y |
| 58 | 58 | 22 | 22721042 | 22735036 | 13994 | loss | 959 | GSTTP2 | Y |
| 58 | 58 | 22 | 22721042 | 22735036 | 13994 | loss | 960 | GSTTP2 | Y |
| 58 | 58 | 22 | 22721042 | 22735036 | 13994 | loss | 964 | GSTTP2 | Y |
| 59 | 59 | 19 | 61081628 | 61083208 | 1580 | gain | 962 | NLRP4 | Y |
| 59 | 59 | 19 | 61081628 | 61083208 | 1580 | gain | 963 | NLRP4 | Y |
| 59 | 59 | 19 | 61081628 | 61083208 | 1580 | gain | 964 | NLRP4 | Y |
| 59 | 59 | 19 | 61081628 | 61083208 | 1580 | gain | 1003 | NLRP4 | Y |
| 59 | 59 | 19 | 61081628 | 61083208 | 1580 | gain | 1013 | NLRP4 | Y |
| 59 | 59 | 19 | 61081628 | 61083208 | 1580 | gain | 1037 | NLRP4 | Y |
| 60 | 60 | 19 | 60132603 | 60136910 | 4307 | loss | 1025 | NLRP7 | Y |
| 61 | 61 | 15 | 99236636 | 99239178 | 2542 | loss | 1014 | ALDH1A3 | Y |
| 61 | 61 | 15 | 99236636 | 99239178 | 2542 | loss | 1029 | ALDH1A3 | Y |
| 62 | 62 | 18 | 65911512 | 65923901 | 12389 | gain | 955 | RTTN | N |
| 62 | 62 | 18 | 65911512 | 65923901 | 12389 | gain | 964 | RTTN | N |
| 63 | 63 | 18 | 65911512 | 65915539 | 4027 | loss | 1017 | RTTN | N |
| 64 | 64 | 18 | 65916736 | 65938721 | 21985 | loss | 1028 | RTTN | Y |
| 65 | 65 | 16 | 6597826 | 6632582 | 34756 | gain | 1014 | RBFOX1 | N |
| 66 | 66 | 16 | 6810852 | 6907294 | 96442 | loss | 982 | RBFOX1 | N |
| 67 | 67 | 10 | 5979772 | 5995714 | 15942 | gain | 1030 | FBXO18 | Y |
| 68 | 68 | 10 | 5984217 | 5995714 | 11497 | gain | 1037 | FBXO18 | Y |
| 69 | 69 | 10 | 5985730 | 5988631 | 2901 | gain | 1000 | FBXO18 | Y |
| 70 | 70 | 5 | 171229766 | 171231310 | 1544 | loss | 967 | FBXW11 | Y |
| 71 | 71 | 5 | 171335918 | 171339127 | 3209 | gain | 971 | FBXW11 | N |
| 72 | 72 | 3 | 55514618 | 55517737 | 3119 | loss | 969 | ERC2 | Y |
| 72 | 72 | 3 | 55514618 | 55517737 | 3119 | loss | 999 | ERC2 | Y |
| 72 | 72 | 3 | 55514618 | 55517737 | 3119 | loss | 1005 | ERC2 | Y |
| 73 | 73 | X | 150893705 | 150894325 | 620 | loss | 981 | GABRE | Y |
| 73 | 73 | X | 150893705 | 150894325 | 620 | loss | 1016 | GABRE | Y |
| 74 | 74 | 15 | 87999026 | 88001610 | 2584 | gain | 954 | KIF7 | Y |
| 75 | 75 | 15 | 87999026 | 88000020 | 994 | gain | 994 | KIF7 | Y |
| 76 | 76 | 14 | 104688404 | 104688435 | 31 | gain | 970 | JAG2 | Y |
| 76 | 76 | 14 | 104688404 | 104688435 | 31 | gain | 980 | JAG2 | Y |
| 76 | 76 | 14 | 104688404 | 104688435 | 31 | gain | 995 | JAG2 | Y |
| 76 | 76 | 14 | 104688404 | 104688435 | 31 | gain | 999 | JAG2 | Y |
| 76 | 76 | 14 | 104688404 | 104688435 | 31 | gain | 1013 | JAG2 | Y |
| 76 | 76 | 14 | 104688404 | 104688435 | 31 | gain | 1035 | JAG2 | Y |
| 77 | 77 | 1 | 204483717 | 204637883 | 154166 | loss | 988 | CTSE, SRGAP2 | Y |
| 77 | 77 | 1 | 204483717 | 204637883 | 154166 | loss | 990 | CTSE, SRGAP2 | Y |
| 78 | 78 | 3 | 199030475 | 199192026 | 161551 | loss | 967 | LMLN, IQCG, RPL35A, LRCH3 | Y |
| 79 | 79 | 3 | 199032255 | 199188547 | 156292 | loss | 948 | LMLN, IQCG, RPL35A, LRCH3 | Y |
| 79 | 79 | 3 | 199032255 | 199188547 | 156292 | loss | 1007 | LMLN, IQCG, RPL35A, LRCH3 | Y |
| 79 | 79 | 3 | 199032255 | 199188547 | 156292 | loss | 1011 | LMLN, IQCG, RPL35A, LRCH3 | Y |
| 80 | 80 | 3 | 199033913 | 199188547 | 154634 | loss | 1031 | LMLN, IQCG, RPL35A, LRCH3 | Y |
| 81 | 81 | 3 | 199038163 | 199188547 | 150384 | loss | 970 | LMLN, IQCG, RPL35A, LRCH3 | Y |
| 82 | 82 | 3 | 199038163 | 199187361 | 149198 | loss | 1034 | LMLN, IQCG, RPL35A, LRCH3 | Y |
| 83 | 83 | 3 | 199040318 | 199188547 | 148229 | loss | 952 | LMLN, IQCG, RPL35A, LRCH3 | Y |
| 84 | 84 | 3 | 199043844 | 199188547 | 144703 | loss | 974 | LMLN, IQCG, RPL35A, LRCH3 | Y |
| 85 | 85 | 4 | 103960184 | 103968003 | 7819 | loss | 989 | UBE2D3 | Y |
| 86 | 86 | 10 | 95534054 | 95536083 | 2029 | loss | 952 | LGI1 | N |
| 86 | 86 | 10 | 95534054 | 95536083 | 2029 | loss | 961 | LGI1 | N |
| 86 | 86 | 10 | 95534054 | 95536083 | 2029 | loss | 968 | LGI1 | N |
| 87 | 87 | 12 | 55879318 | 55902123 | 22805 | gain | 1030 | LRP1, NXPH4 | Y |
| 88 | 88 | 12 | 55880398 | 55902123 | 21725 | gain | 997 | LRP1, NXPH4 | Y |
| 89 | 89 | 10 | 5965889 | 5995714 | 29825 | gain | 992 | ANKRD16, FBXO18 | Y |
| 90 | 90 | 8 | 31639124 | 31642682 | 3558 | loss | 1029 | NRG1 | N |

TABLE 1-continued

| Priority Number | Seq ID | Chr | Start | Stop | Size | CNV Type | PD Case ID | RefSeq Gene Symbol | Exon overlap |
|---|---|---|---|---|---|---|---|---|---|
| 91 | 91 | 8 | 31811829 | 31815721 | 3892 | loss | 1034 | NRG1 | N |
| 92 | 92 | 8 | 31814234 | 31815721 | 1487 | loss | 1017 | NRG1 | N |
| 93 | 93 | 8 | 32551972 | 32553445 | 1473 | loss | 1029 | NRG1 | N |
| 94 | 94 | 10 | 84165642 | 84171045 | 5403 | gain | 988 | NRG3 | N |
| 95 | 95 | 10 | 84188750 | 84190301 | 1551 | gain | 977 | NRG3 | N |
| 96 | 96 | 12 | 5390135 | 5414622 | 24487 | loss | 1026 | NTF3 | Y |
| 97 | 97 | 12 | 5401060 | 5417862 | 16802 | loss | 1019 | NTF3 | Y |
| 98 | 98 | 4 | 103310758 | 104753531 | 1442773 | gain | 965 | CISD2, MANBA, TACR3, CENPE, UBE2D3, SLC39A8, SLC9B1, NFKB1, SLC9B2, BDH2 | Y |
| 99 | 99 | 7 | 141413352 | 141442231 | 28879 | gain | 999 | MGAM | Y |
| 99 | 99 | 7 | 141413352 | 141442231 | 28879 | gain | 1030 | MGAM | Y |
| 100 | 100 | 5 | 140201609 | 140219465 | 17856 | loss | 1024 | PCDHA2, PCDHA3, PCDHA1, PCDHA6, PCDHA7, PCDHA4, PCDHA5, PCDHA8, PCDHA9, PCDHA10 | Y |
| 101 | 101 | 5 | 140203440 | 140219465 | 16025 | loss | 1004 | PCDHA2, PCDHA3, PCDHA1, PCDHA6, PCDHA7, PCDHA4, PCDHA5, PCDHA8, PCDHA9, PCDHA10 | Y |
| 101 | 101 | 5 | 140203440 | 140219465 | 16025 | loss | 1034 | PCDHA2, PCDHA3, PCDHA1, PCDHA6, PCDHA7, PCDHA4, PCDHA5, PCDHA8, PCDHA9, PCDHA10 | Y |
| 102 | 102 | 22 | 42895171 | 42898071 | 2900 | gain | 992 | PARVB | Y |
| 102 | 102 | 22 | 42895171 | 42898071 | 2900 | gain | 993 | PARVB | Y |
| 102 | 102 | 22 | 42895171 | 42898071 | 2900 | gain | 1013 | PARVB | Y |
| 103 | 103 | 12 | 15557675 | 15560873 | 3198 | loss | 990 | PTPRO | Y |
| 104 | 104 | 12 | 15557675 | 15559369 | 1694 | loss | 991 | PTPRO | N |
| 103 | 103 | 12 | 15557675 | 15560873 | 3198 | loss | 1011 | PTPRO | Y |
| 105 | 105 | 1 | 108535814 | 108543860 | 8046 | loss | 959 | SLC25A24 | Y |
| 105 | 105 | 1 | 108535814 | 108543860 | 8046 | loss | 1029 | SLC25A24 | Y |
| 106 | 106 | 14 | 60544757 | 60553070 | 8313 | loss | 991 | SLC38A6 | Y |
| 106 | 106 | 14 | 60544757 | 60553070 | 8313 | loss | 1034 | SLC38A6 | Y |
| 107 | 107 | 14 | 60551981 | 60553070 | 1089 | gain | 951 | SLC38A6 | Y |
| 107 | 107 | 14 | 60551981 | 60553070 | 1089 | loss | 954 | SLC38A6 | Y |
| 107 | 107 | 14 | 60551981 | 60553070 | 1089 | loss | 1014 | SLC38A6 | Y |
| 107 | 107 | 14 | 60551981 | 60553070 | 1089 | loss | 1019 | SLC38A6 | Y |
| 108 | 108 | 4 | 47314693 | 47323346 | 8653 | loss | 1033 | CORIN | Y |
| 109 | 109 | 4 | 47361851 | 47362999 | 1148 | gain | 978 | CORIN | Y |
| 110 | 110 | 12 | 31132716 | 31298659 | 165943 | gain | 975 | DDX11 | Y |
| 111 | 111 | 12 | 31132716 | 31237505 | 104789 | gain | 990 | DDX11 | Y |
| 111 | 111 | 12 | 31132716 | 31237505 | 104789 | gain | 1004 | DDX11 | Y |
| 112 | 112 | 12 | 31084265 | 31242528 | 158263 | gain | 977 | DDX11-AS1, DDX11 | Y |
| 113 | 113 | 12 | 31098259 | 31237505 | 139246 | gain | 966 | DDX11-AS1, DDX11 | Y |
| 114 | 114 | 12 | 31098259 | 31242528 | 144269 | gain | 992 | DDX11-AS1, DDX11 | Y |
| 113 | 113 | 12 | 31098259 | 31237505 | 139246 | gain | 1011 | DDX11-AS1, DDX11 | Y |
| 113 | 113 | 12 | 31098259 | 31237505 | 139246 | gain | 1031 | DDX11-AS1, DDX11 | Y |
| 115 | 115 | 1 | 194977713 | 195065867 | 88154 | loss | 1028 | CFHR3, CFHR1, CFH | Y |
| 116 | 116 | 1 | 194978218 | 195065867 | 87649 | loss | 961 | CFHR3, CFHR1, CFH | Y |
| 116 | 116 | 1 | 194978218 | 195065867 | 87649 | loss | 990 | CFHR3, CFHR1, CFH | Y |
| 116 | 116 | 1 | 194978218 | 195065867 | 87649 | loss | 996 | CFHR3, CFHR1, CFH | Y |
| 117 | 117 | 1 | 194977713 | 195127881 | 150168 | loss | 1001 | CFHR3, CFHR1, CFHR4, CFH | Y |
| 118 | 118 | 18 | 42831086 | 42836022 | 4936 | gain | 947 | KATNAL2 | Y |
| 118 | 118 | 18 | 42831086 | 42836022 | 4936 | gain | 953 | KATNAL2 | Y |
| 118 | 118 | 18 | 42831086 | 42836022 | 4936 | gain | 971 | KATNAL2 | Y |
| 118 | 118 | 18 | 42831086 | 42836022 | 4936 | gain | 988 | KATNAL2 | Y |
| 118 | 118 | 18 | 42831086 | 42836022 | 4936 | gain | 1006 | KATNAL2 | Y |
| 119 | 119 | 19 | 54252049 | 54268744 | 16695 | loss | 992 | KCNA7, NTF4 | Y |
| 120 | 120 | 4 | 57739809 | 57789510 | 49701 | loss | 976 | LOC255130 | Y |
| 120 | 120 | 4 | 57739809 | 57789510 | 49701 | loss | 986 | LOC255130 | Y |
| 120 | 120 | 4 | 57739809 | 57789510 | 49701 | loss | 1029 | LOC255130 | Y |
| 121 | 121 | 4 | 57742531 | 57789510 | 46979 | loss | 951 | LOC255130 | Y |
| 122 | 122 | 4 | 57742531 | 57783444 | 40913 | loss | 1019 | LOC255130 | Y |
| 123 | 123 | 7 | 151726377 | 151747905 | 21528 | loss | 967 | MLL3 | N |
| 124 | 124 | 7 | 151726377 | 151743145 | 16768 | loss | 995 | MLL3 | N |
| 124 | 124 | 7 | 151726377 | 151743145 | 16768 | loss | 1002 | MLL3 | N |
| 124 | 124 | 7 | 151726377 | 151743145 | 16768 | loss | 1019 | MLL3 | N |
| 125 | 125 | 7 | 151728811 | 151743145 | 14334 | loss | 950 | MLL3 | N |
| 126 | 126 | 7 | 151465378 | 151895559 | 430181 | gain | 958 | MLL3, FABP5P3, LOC100128822 | Y |

TABLE 1-continued

| Priority Number | Seq ID | Chr | Start | Stop | Size | CNV Type | PD Case ID | RefSeq Gene Symbol | Exon overlap |
|---|---|---|---|---|---|---|---|---|---|
| 127 | 127 | 18 | 31204187 | 31210105 | 5918 | gain | 947 | ZNF396 | Y |
| 127 | 127 | 18 | 31204187 | 31210105 | 5918 | gain | 953 | ZNF396 | Y |
| 127 | 127 | 18 | 31204187 | 31210105 | 5918 | gain | 958 | ZNF396 | Y |
| 127 | 127 | 18 | 31204187 | 31210105 | 5918 | gain | 959 | ZNF396 | Y |
| 127 | 127 | 18 | 31204187 | 31210105 | 5918 | gain | 973 | ZNF396 | Y |
| 128 | 128 | 17 | 6399283 | 6401166 | 1883 | loss | 978 | PITPNM3 | Y |
| 128 | 128 | 17 | 6399283 | 6401166 | 1883 | gain | 992 | PITPNM3 | Y |
| 128 | 128 | 17 | 6399283 | 6401166 | 1883 | gain | 1013 | PITPNM3 | Y |
| 128 | 128 | 17 | 6399283 | 6401166 | 1883 | gain | 1017 | PITPNM3 | Y |
| 129 | 129 | 17 | 62868652 | 62873107 | 4455 | loss | 1009 | PITPNC1 | N |
| 130 | 130 | 17 | 62869966 | 62877923 | 7957 | loss | 1007 | PITPNC1 | N |
| 131 | 131 | 1 | 103899771 | 104012520 | 112749 | loss | 1003 | ACTG1P4, AMY2A, AMY2B, AMY1A, AMY1C, AMY1B | Y |
| 132 | 132 | 1 | 103901454 | 104012520 | 111066 | loss | 1027 | ACTG1P4, AMY2A, AMY2B, AMY1A, AMY1C, AMY1B | Y |
| 133 | 133 | 1 | 103839772 | 103904723 | 64951 | gain | 998 | AMY2B, RNPC3 | Y |
| 134 | 134 | 5 | 126784243 | 126788155 | 3912 | loss | 1013 | MEGF10 | Y |
| 135 | 135 | 5 | 126786974 | 126788155 | 1181 | loss | 986 | MEGF10 | N |
| 135 | 135 | 5 | 126786974 | 126788155 | 1181 | loss | 1012 | MEGF10 | N |
| 136 | 136 | 19 | 9134840 | 9144715 | 9875 | loss | 994 | ZNF317 | Y |
| 136 | 136 | 19 | 9134840 | 9144715 | 9875 | loss | 1008 | ZNF317 | Y |
| 136 | 136 | 19 | 9134840 | 9144715 | 9875 | loss | 1024 | ZNF317 | Y |
| 137 | 137 | 8 | 94041443 | 94059962 | 18519 | loss | 1025 | TRIQK | Y |
| 138 | 138 | 8 | 94043277 | 94045697 | 2420 | loss | 1018 | TRIQK | N |
| 139 | 139 | 22 | 45468407 | 45474188 | 5781 | gain | 966 | CERK | Y |
| 140 | 140 | 9 | 98831789 | 98831814 | 25 | gain | 999 | CTSL2 | Y |
| 140 | 140 | 9 | 98831789 | 98831814 | 25 | gain | 1018 | CTSL2 | Y |
| 141 | 141 | 10 | 88905200 | 89245881 | 340681 | gain | 969 | LOC439994, FAM22D, FAM22A, LOC728190, LOC728218, FAM35A | Y |
| 141 | 141 | 10 | 88905200 | 89245881 | 340681 | gain | 999 | LOC439994, FAM22D, FAM22A, LOC728190, LOC728218, FAM35A | Y |
| 142 | 142 | 6 | 160246670 | 160248266 | 1596 | loss | 986 | MAS1 | Y |
| 142 | 142 | 6 | 160246670 | 160248266 | 1596 | loss | 1031 | MAS1 | Y |
| 143 | 143 | 13 | 102137609 | 102142982 | 5373 | loss | 997 | METTL21C | Y |
| 144 | 144 | 13 | 102139658 | 102142982 | 3324 | loss | 1004 | METTL21C | Y |
| 145 | 145 | 7 | 156485711 | 156495904 | 10193 | loss | 1014 | MNX1 | Y |
| 146 | 146 | 7 | 156485711 | 156490484 | 4773 | loss | 1016 | MNX1 | Y |
| 147 | 147 | 1 | 211022043 | 211027746 | 5703 | loss | 1001 | NSL1 | Y |
| 147 | 147 | 1 | 211022043 | 211027746 | 5703 | loss | 1036 | NSL1 | Y |
| 148 | 148 | 3 | 198177030 | 198187875 | 10845 | gain | 967 | PIGZ | Y |
| 148 | 148 | 3 | 198177030 | 198187875 | 10845 | gain | 975 | PIGZ | Y |
| 149 | 149 | 16 | 70561211 | 70562690 | 1479 | gain | 948 | PKD1L3 | Y |
| 149 | 149 | 16 | 70561211 | 70562690 | 1479 | gain | 1033 | PKD1L3 | Y |
| 150 | 150 | 8 | 37754788 | 37755937 | 1149 | gain | 946 | PROSC | Y |
| 150 | 150 | 8 | 37754788 | 37755937 | 1149 | gain | 1007 | PROSC | Y |
| 151 | 151 | 8 | 85403103 | 85404716 | 1613 | gain | 954 | RALYL | N |
| 152 | 152 | 8 | 85418745 | 85431319 | 12574 | gain | 1037 | RALYL | Y |
| 153 | 153 | 8 | 85420037 | 85431319 | 11282 | gain | 1024 | RALYL | Y |
| 154 | 154 | 8 | 85422157 | 85431319 | 9162 | gain | 957 | RALYL | N |
| 154 | 154 | 8 | 85422157 | 85431319 | 9162 | gain | 992 | RALYL | N |
| 154 | 154 | 8 | 85422157 | 85431319 | 9162 | gain | 997 | RALYL | N |
| 154 | 154 | 8 | 85422157 | 85431319 | 9162 | gain | 1000 | RALYL | N |
| 154 | 154 | 8 | 85422157 | 85431319 | 9162 | gain | 1003 | RALYL | N |
| 154 | 154 | 8 | 85422157 | 85431319 | 9162 | gain | 1028 | RALYL | N |
| 154 | 154 | 8 | 85422157 | 85431319 | 9162 | gain | 1030 | RALYL | N |
| 155 | 155 | 8 | 85839690 | 85842807 | 3117 | loss | 949 | RALYL | N |
| 156 | 156 | 13 | 113791151 | 113792974 | 1823 | loss | 951 | RASA3 | Y |
| 156 | 156 | 13 | 113791151 | 113792974 | 1823 | loss | 972 | RASA3 | Y |
| 156 | 156 | 13 | 113791151 | 113792974 | 1823 | loss | 973 | RASA3 | Y |
| 156 | 156 | 13 | 113791151 | 113792974 | 1823 | loss | 980 | RASA3 | Y |
| 157 | 157 | 13 | 113791151 | 113794669 | 3518 | loss | 989 | RASA3 | Y |
| 157 | 157 | 13 | 113791151 | 113794669 | 3518 | loss | 991 | RASA3 | Y |
| 158 | 158 | 5 | 145597802 | 145602068 | 4266 | gain | 980 | RBM27 | N |
| 159 | 159 | 5 | 145627474 | 145645004 | 17530 | gain | 950 | RBM27 | Y |
| 160 | 160 | 5 | 145627474 | 145628667 | 1193 | loss | 1004 | RBM27 | Y |
| 161 | 161 | 14 | 72597009 | 72603806 | 6797 | loss | 1007 | RBM25 | N |
| 161 | 161 | 14 | 72597009 | 72603806 | 6797 | loss | 1025 | RBM25 | N |
| 162 | 162 | 5 | 33493254 | 33494402 | 1148 | loss | 992 | TARS | Y |
| 162 | 162 | 5 | 33493254 | 33494402 | 1148 | loss | 1013 | TARS | Y |
| 163 | 163 | 6 | 133004187 | 133008146 | 3959 | loss | 1017 | TAAR1 | Y |
| 164 | 164 | 13 | 51954511 | 51973943 | 19432 | loss | 1009 | TPTE2P3 | Y |
| 164 | 164 | 13 | 51954511 | 51973943 | 19432 | loss | 1014 | TPTE2P3 | Y |

TABLE 1-continued

| Priority Number | Seq ID | Chr | Start | Stop | Size | CNV Type | PD Case ID | RefSeq Gene Symbol | Exon overlap |
|---|---|---|---|---|---|---|---|---|---|
| 165 | 165 | 14 | 102401445 | 102414214 | 12769 | loss | 997 | TRAF3 | Y |
| 166 | 166 | 14 | 102406606 | 102409996 | 3390 | loss | 969 | TRAF3 | Y |
| 167 | 167 | 3 | 115911311 | 115919955 | 8644 | loss | 1034 | ZBTB20 | Y |
| 167 | 167 | 3 | 115911311 | 115919955 | 8644 | loss | 1036 | ZBTB20 | Y |
| 168 | 168 | 13 | 113574877 | 113602677 | 27800 | loss | 1020 | FAM70B, GAS6-AS1, GAS6 | Y |
| 169 | 169 | 13 | 113576560 | 113602677 | 26117 | loss | 1037 | FAM70B, GAS6-AS1, GAS6 | Y |
| 170 | 170 | 2 | 54308895 | 54356768 | 47873 | gain | 983 | TSPYL6, ACYP2 | Y |
| 171 | 171 | 7 | 133903992 | 133913921 | 9929 | loss | 983 | AKR1B15 | Y |
| 172 | 172 | 7 | 133906667 | 133910372 | 3705 | loss | 1032 | AKR1B15 | Y |
| 173 | 173 | 13 | 24166764 | 24232405 | 65641 | gain | 1002 | ATP12A | Y |
| 174 | 174 | 7 | 43804939 | 43809287 | 4348 | gain | 1016 | BLVRA | Y |
| 175 | 175 | 7 | 43807656 | 43810836 | 3180 | gain | 1004 | BLVRA | Y |
| 176 | 176 | 16 | 84330410 | 84332684 | 2274 | loss | 1034 | C16orf74, MIR1910 | Y |
| 177 | 177 | 16 | 84332684 | 84335524 | 2840 | loss | 999 | C16orf74, MIR1910 | Y |
| 178 | 178 | 3 | 11705809 | 11869809 | 164000 | gain | 989 | TAMM41, VGLL4 | Y |
| 179 | 179 | 1 | 85964576 | 85967615 | 3039 | gain | 948 | COL24A1 | Y |
| 179 | 179 | 1 | 85964576 | 85967615 | 3039 | gain | 984 | COL24A1 | Y |
| 179 | 179 | 1 | 85964576 | 85967615 | 3039 | gain | 991 | COL24A1 | Y |
| 179 | 179 | 1 | 85964576 | 85967615 | 3039 | gain | 993 | COL24A1 | Y |
| 179 | 179 | 1 | 85964576 | 85967615 | 3039 | gain | 994 | COL24A1 | Y |
| 179 | 179 | 1 | 85964576 | 85967615 | 3039 | gain | 998 | COL24A1 | Y |
| 179 | 179 | 1 | 85964576 | 85967615 | 3039 | gain | 1005 | COL24A1 | Y |
| 179 | 179 | 1 | 85964576 | 85967615 | 3039 | loss | 1009 | COL24A1 | Y |
| 179 | 179 | 1 | 85964576 | 85967615 | 3039 | gain | 1010 | COL24A1 | Y |
| 179 | 179 | 1 | 85964576 | 85967615 | 3039 | gain | 1011 | COL24A1 | Y |
| 179 | 179 | 1 | 85964576 | 85967615 | 3039 | gain | 1013 | COL24A1 | Y |
| 179 | 179 | 1 | 85964576 | 85967615 | 3039 | gain | 1014 | COL24A1 | Y |
| 179 | 179 | 1 | 85964576 | 85967615 | 3039 | gain | 1015 | COL24A1 | Y |
| 179 | 179 | 1 | 85964576 | 85967615 | 3039 | gain | 1020 | COL24A1 | Y |
| 180 | 180 | 5 | 150082708 | 150087911 | 5203 | gain | 964 | DCTN4 | Y |
| 181 | 181 | 5 | 150084557 | 150086690 | 2133 | gain | 971 | DCTN4 | N |
| 182 | 182 | 7 | 14179928 | 14185615 | 5687 | loss | 989 | DGKB | Y |
| 183 | 183 | 7 | 14727426 | 14731583 | 4157 | gain | 977 | DGKB | N |
| 184 | 184 | 11 | 84499641 | 84610167 | 110526 | loss | 1026 | DLG2 | Y |
| 185 | 185 | 11 | 84972646 | 84980750 | 8104 | loss | 1003 | DLG2 | N |
| 186 | 186 | 13 | 112811735 | 112813401 | 1666 | loss | 965 | F7 | Y |
| 186 | 186 | 13 | 112811735 | 112813401 | 1666 | loss | 971 | F7 | Y |
| 186 | 186 | 13 | 112811735 | 112813401 | 1666 | loss | 972 | F7 | Y |
| 186 | 186 | 13 | 112811735 | 112813401 | 1666 | loss | 973 | F7 | Y |
| 186 | 186 | 13 | 112811735 | 112813401 | 1666 | loss | 978 | F7 | Y |
| 186 | 186 | 13 | 112811735 | 112813401 | 1666 | loss | 992 | F7 | Y |
| 187 | 187 | 9 | 39048058 | 43599449 | 4551391 | loss | 980 | LOC653501, FAM95B1, KGFLP2, SPATA31A1, SPATA31A2, SPATA31A3, SPATA31A4, SPATA31A5, SPATA31A6, SPATA31A7, FAM74A1, FAM74A3, LOC642929, FOXD4L4, FOXD4L2, LOC286297, ZNF658B, ANKRD20A2, MGC21881, CNTNAP3, LOC643648, AQP7P3, ZNF658, ANKRD20A3 | Y |
| 188 | 188 | 9 | 39062211 | 435994 | 494537238 | loss | 982 | LOC653501, FAM95B1, KGFLP2, SPATA31A1, SPATA31A2, SPATA31A3, SPATA31A4, SPATA31A5, SPATA31A6, 5PATA31A7, FAM74A1, FAM74A3, LOC642929, FOXD4L4, FOXD4L2, LOC286297, ZNF658B, ANKRD20A2, MGC21881, CNTNAP3, LOC643648, AQP7P3, ZNF658, ANKRD20A3 | Y |
| 189 | 189 | 9 | 38758232 | 44199401 | 5441169 | loss | 975 | LOC653501, FAM95B1, KGFLP2, SPATA31A1, SPATA31A2, SPATA31A3, SPATA31A4, SPATA31A5, SPATA31A6, SPATA31A7, FAM74A1, FAM74A3, CNTNAP3B, LOC642929, FOXD4L4, FOXD4L2, LOC286297, ZNF658B, | Y |

TABLE 1-continued

| Priority Number | Seq ID | Chr | Start | Stop | Size | CNV Type | PD Case ID | RefSeq Gene Symbol | Exon overlap |
|---|---|---|---|---|---|---|---|---|---|
| 190 | 190 | 9 | 39048058 | 43776365 | 4728307 | loss | 967 | LOC653501, FAM95B1, KGFLP2, SPATA31A1, SPATA31A2, SPATA31A3, SPATA31A4, SPATA31A5, SPATA31A6, SPATA31A7, FAM74A1, FAM74A3, CNTNAP3B, LOC642929, FOXD4L4, FOXD4L2, LOC286297, ZNF658B, ANKRD20A2, MGC21881, CNTNAP3, LOC643648, AQP7P3, ZNF658, ANKRD20A3 | Y |
| 191 | 191 | 9 | 39048058 | 43626920 | 4578862 | loss | 992 | LOC653501, FAM95B1, KGFLP2, SPATA31A1, SPATA31A2, SPATA31A3, SPATA31A4, SPATA31A5, SPATA31A6, SPATA31A7, FAM74A1, FAM74A3, CNTNAP3B, LOC642929, FOXD4L4, FOXD4L2, LOC286297, ZNF658B, ANKRD20A2, MGC21881, CNTNAP3, LOC643648, AQP7P3, ZNF658, ANKRD20A3 | Y |
| 190 | 190 | 9 | 39048058 | 43776365 | 4728307 | loss | 994 | LOC653501, FAM95B1, KGFLP2, SPATA31A1, SPATA31A2, SPATA31A3, SPATA31A4, SPATA31A5, SPATA31A6, SPATA31A7, FAM74A1, FAM74A3, CNTNAP3B, LOC642929, FOXD4L4, FOXD4L2, LOC286297, ZNF658B, ANKRD20A2, MGC21881, CNTNAP3, LOC643648, AQP7P3, ZNF658, ANKRD20A3 | Y |
| 192 | 192 | 9 | 39091349 | 44199401 | 5108052 | loss | 970 | LOC653501, FAM95B1, KGFLP2, SPATA31A1, SPATA31A2, SPATA31A3, SPATA31A4, SPATA31A5, SPATA31A6, SPATA31A7, FAM74A1, FAM74A3, CNTNAP3B, LOC642929, FOXD4L4, FOXD4L2, LOC286297, ZNF658B, ANKRD20A2, MGC21881, CNTNAP3, LOC643648, AQP7P3, ZNF658, ANKRD20A3 | Y |
| 193 | 193 | 9 | 38758232 | 45359327 | 6601095 | loss | 966 | LOC653501, FAM95B1, KGFLP2, SPATA31A1, SPATA31A2, SPATA31A3, SPATA31A4, SPATA31A5, SPATA31A6, SPATA31A7, FAM74A1, FAM74A3, CNTNAP3B, LOC642929, FOXD4L4, FOXD4L2, LOC286297, ZNF658B, ANKRD20A2, MGC21881, CNTNAP3, LOC643648, AQP7P3, ZNF658, ANKRD20A3 | Y |
| 194 | 194 | X | 29367686 | 29369448 | 1762 | gain | 958 | IL1RAPL1 | N |
| 195 | 195 | X | 29595687 | 29597689 | 2002 | loss | 1035 | IL1RAPL1 | Y |
| 196 | 196 | X | 104510036 | 104512681 | 2645 | loss | 979 | IL1RAPL2 | N |
| 196 | 196 | X | 104510036 | 104512681 | 2645 | loss | 1003 | IL1RAPL2 | N |
| 196 | 196 | X | 104510036 | 104512681 | 2645 | loss | 1023 | IL1RAPL2 | N |
| 197 | 197 | 1 | 1707874 | 1914525 | 206651 | gain | 1020 | KIAA1751, TMEM52, GNB1, CALML6 | Y |

TABLE 1-continued

| Priority Number | Seq ID | Chr | Start | Stop | Size | CNV Type | PD Case ID | RefSeq Gene Symbol | Exon overlap |
|---|---|---|---|---|---|---|---|---|---|
| 198 | 198 | 12 | 10465787 | 10540088 | 74301 | gain | 947 | KLRC1, KLRC2 | Y |
| 199 | 199 | 12 | 10464018 | 10534393 | 70375 | gain | 979 | KLRC1, KLRC3, KLRC2 | Y |
| 200 | 200 | 8 | 144845724 | 144863110 | 17386 | loss | 1008 | BREA2, ZNF707, CCDC166 | Y |
| 200 | 200 | 8 | 144845724 | 144863110 | 17386 | loss | 1024 | BREA2, ZNF707, CCDC166 | Y |
| 201 | 201 | 11 | 88258151 | 88274575 | 16424 | loss | 949 | GRM5 | N |
| 202 | 202 | 11 | 88268465 | 88305485 | 37020 | loss | 1003 | GRM5 | N |
| 203 | 203 | 17 | 41501967 | 41710400 | 208433 | loss | 1024 | KANSL1, KANSL1-AS1 | Y |
| 204 | 204 | 17 | 41519702 | 41710400 | 190698 | loss | 1028 | KANSL1, KANSL1-AS1 | Y |
| 205 | 205 | 10 | 76129083 | 76135755 | 6672 | gain | 955 | ADK | N |
| 205 | 205 | 10 | 76129083 | 76135755 | 6672 | gain | 959 | ADK | N |
| 205 | 205 | 10 | 76129083 | 76135755 | 6672 | gain | 964 | ADK | N |
| 205 | 205 | 10 | 76129083 | 76135755 | 6672 | loss | 988 | ADK | N |
| 205 | 205 | 10 | 76129083 | 76135755 | 6672 | loss | 1007 | ADK | N |
| 206 | 206 | 10 | 60139394 | 60201113 | 61719 | gain | 992 | FAM133CP, BICC1 | Y |
| 207 | 207 | 3 | 174692234 | 174701950 | 9716 | gain | 952 | NLGN1 | N |
| 208 | 208 | 3 | 174692234 | 174704469 | 12235 | gain | 975 | NLGN1 | N |
| 208 | 208 | 3 | 174692234 | 174704469 | 12235 | gain | 978 | NLGN1 | N |
| 209 | 209 | 3 | 174692234 | 174706670 | 14436 | gain | 1020 | NLGN1 | N |
| 208 | 208 | 3 | 174692234 | 174704469 | 12235 | gain | 1022 | NLGN1 | N |
| 210 | 210 | 3 | 174692778 | 174708603 | 15825 | gain | 1034 | NLGN1 | N |
| 211 | 211 | 19 | 794973 | 798817 | 3844 | gain | 961 | PRTN3 | Y |
| 212 | 212 | 19 | 794973 | 801351 | 6378 | loss | 998 | PRTN3 | Y |
| 213 | 213 | 8 | 99038720 | 99041695 | 2975 | loss | 1004 | MATN2 | N |
| 214 | 214 | 8 | 99039952 | 99041695 | 1743 | loss | 968 | MATN2 | N |
| 214 | 214 | 8 | 99039952 | 99041695 | 1743 | loss | 975 | MATN2 | N |
| 214 | 214 | 8 | 99039952 | 99041695 | 1743 | loss | 993 | MATN2 | N |
| 215 | 215 | 6 | 134624093 | 134635779 | 11686 | gain | 953 | SGK1 | Y |
| 215 | 215 | 6 | 134624093 | 134635779 | 11686 | gain | 957 | SGK1 | Y |
| 215 | 215 | 6 | 134624093 | 134635779 | 11686 | gain | 963 | SGK1 | Y |
| 215 | 215 | 6 | 134624093 | 134635779 | 11686 | gain | 981 | SGK1 | Y |
| 215 | 215 | 6 | 134624093 | 134635779 | 11686 | gain | 984 | SGK1 | Y |
| 215 | 215 | 6 | 134624093 | 134635779 | 11686 | gain | 1003 | SGK1 | Y |
| 215 | 215 | 6 | 134624093 | 134635779 | 11686 | gain | 1005 | SGK1 | Y |
| 216 | 216 | 2 | 3708749 | 3714236 | 5487 | loss | 995 | ALLC | N |
| 216 | 216 | 2 | 3708749 | 3714236 | 5487 | loss | 1001 | ALLC | N |
| 216 | 216 | 2 | 3708749 | 3714236 | 5487 | loss | 1018 | ALLC | N |
| 216 | 216 | 2 | 3708749 | 3714236 | 5487 | loss | 1019 | ALLC | N |
| 217 | 217 | 5 | 134286886 | 134289928 | 3042 | gain | 961 | PCBD2 | N |
| 217 | 217 | 5 | 134286886 | 134289928 | 3042 | gain | 975 | PCBD2 | N |
| 217 | 217 | 5 | 134286886 | 134289928 | 3042 | gain | 993 | PCBD2 | N |
| 217 | 217 | 5 | 134286886 | 134289928 | 3042 | gain | 1030 | PCBD2 | N |
| 218 | 218 | 2 | 214581782 | 214586936 | 5154 | loss | 993 | SPAG16 | Y |
| 219 | 219 | 2 | 214805561 | 214828475 | 22914 | gain | 1018 | SPAG16 | N |
| 220 | 220 | 2 | 214886207 | 214887681 | 1474 | loss | 999 | SPAG16 | N |
| 221 | 221 | 8 | 144970607 | 144970777 | 170 | gain | 946 | PUF60 | Y |
| 221 | 221 | 8 | 144970607 | 144970777 | 170 | gain | 949 | PUF60 | Y |
| 221 | 221 | 8 | 144970607 | 144970777 | 170 | gain | 961 | PUF60 | Y |
| 221 | 221 | 8 | 144970607 | 144970777 | 170 | gain | 968 | PUF60 | Y |
| 221 | 221 | 8 | 144970607 | 144970777 | 170 | gain | 974 | PUF60 | Y |
| 221 | 221 | 8 | 144970607 | 144970777 | 170 | gain | 975 | PUF60 | Y |
| 221 | 221 | 8 | 144970607 | 144970777 | 170 | gain | 1034 | PUF60 | Y |
| 222 | 222 | 8 | 74526051 | 74527806 | 1755 | gain | 1032 | STAU2 | N |
| 223 | 223 | 8 | 74753295 | 74778653 | 25358 | gain | 1012 | STAU2 | Y |
| 224 | 224 | 8 | 74753948 | 74761544 | 7596 | gain | 992 | STAU2 | N |
| 225 | 225 | 8 | 88382155 | 88388307 | 6152 | gain | 964 | CNBD1 | N |
| 225 | 225 | 8 | 88382155 | 88388307 | 6152 | gain | 971 | CNBD1 | N |
| 225 | 225 | 8 | 88382155 | 88388307 | 6152 | gain | 975 | CNBD1 | N |
| 225 | 225 | 8 | 88382155 | 88388307 | 6152 | loss | 990 | CNBD1 | N |
| 226 | 226 | 10 | 122623381 | 122626509 | 3128 | gain | 966 | WDR11, MIR5694 | Y |
| 227 | 227 | 10 | 122633344 | 122640560 | 7216 | gain | 950 | WDR11, MIR5694 | Y |
| 228 | 228 | 5 | 179430821 | 179431937 | 1116 | loss | 947 | RNF130 | Y |
| 228 | 228 | 5 | 179430821 | 179431937 | 1116 | loss | 953 | RNF130 | Y |
| 228 | 228 | 5 | 179430821 | 179431937 | 1116 | loss | 955 | RNF130 | Y |
| 228 | 228 | 5 | 179430821 | 179431937 | 1116 | loss | 957 | RNF130 | Y |
| 228 | 228 | 5 | 179430821 | 179431937 | 1116 | loss | 958 | RNF130 | Y |
| 228 | 228 | 5 | 179430821 | 179431937 | 1116 | loss | 959 | RNF130 | Y |
| 228 | 228 | 5 | 179430821 | 179431937 | 1116 | loss | 960 | RNF130 | Y |
| 228 | 228 | 5 | 179430821 | 179431937 | 1116 | loss | 971 | RNF130 | Y |
| 228 | 228 | 5 | 179430821 | 179431937 | 1116 | loss | 977 | RNF130 | Y |
| 228 | 228 | 5 | 179430821 | 179431937 | 1116 | loss | 982 | RNF130 | Y |
| 228 | 228 | 5 | 179430821 | 179431937 | 1116 | loss | 997 | RNF130 | Y |
| 228 | 228 | 5 | 179430821 | 179431937 | 1116 | loss | 1001 | RNF130 | Y |
| 228 | 228 | 5 | 179430821 | 179431937 | 1116 | loss | 1003 | RNF130 | Y |
| 228 | 228 | 5 | 179430821 | 179431937 | 1116 | loss | 1006 | RNF130 | Y |

TABLE 1-continued

| Priority Number | Seq ID | Chr | Start | Stop | Size | CNV Type | PD Case ID | RefSeq Gene Symbol | Exon overlap |
|---|---|---|---|---|---|---|---|---|---|
| 228 | 228 | 5 | 179430821 | 179431937 | 1116 | loss | 1031 | RNF130 | Y |
| 228 | 228 | 5 | 179430821 | 179431937 | 1116 | loss | 1033 | RNF130 | Y |
| 229 | 229 | 15 | 99634434 | 99635701 | 1267 | gain | 960 | VIMP | Y |
| 229 | 229 | 15 | 99634434 | 99635701 | 1267 | gain | 969 | VIMP | Y |
| 229 | 229 | 15 | 99634434 | 99635701 | 1267 | gain | 971 | VIMP | Y |
| 229 | 229 | 15 | 99634434 | 99635701 | 1267 | gain | 984 | VIMP | Y |
| 229 | 229 | 15 | 99634434 | 99635701 | 1267 | gain | 992 | VIMP | Y |
| 229 | 229 | 15 | 99634434 | 99635701 | 1267 | gain | 993 | VIMP | Y |
| 229 | 229 | 15 | 99634434 | 99635701 | 1267 | gain | 994 | VIMP | Y |
| 229 | 229 | 15 | 99634434 | 99635701 | 1267 | gain | 997 | VIMP | Y |
| 229 | 229 | 15 | 99634434 | 99635701 | 1267 | loss | 998 | VIMP | Y |
| 229 | 229 | 15 | 99634434 | 99635701 | 1267 | gain | 1000 | VIMP | Y |
| 229 | 229 | 15 | 99634434 | 99635701 | 1267 | gain | 1003 | VIMP | Y |
| 229 | 229 | 15 | 99634434 | 99635701 | 1267 | loss | 1004 | VIMP | Y |
| 229 | 229 | 15 | 99634434 | 99635701 | 1267 | gain | 1017 | VIMP | Y |
| 229 | 229 | 15 | 99634434 | 99635701 | 1267 | gain | 1025 | VIMP | Y |
| 229 | 229 | 15 | 99634434 | 99635701 | 1267 | gain | 1028 | VIMP | Y |
| 229 | 229 | 15 | 99634434 | 99635701 | 1267 | loss | 1029 | VIMP | Y |
| 229 | 229 | 15 | 99634434 | 99635701 | 1267 | gain | 1035 | VIMP | Y |
| 230 | 230 | 19 | 42537228 | 42537766 | 538 | loss | 990 | HKR1 | N |
| 230 | 230 | 19 | 42537228 | 42537766 | 538 | loss | 991 | HKR1 | N |
| 231 | 231 | 19 | 42537228 | 42544684 | 7456 | loss | 1014 | HKR1 | N |
| 230 | 230 | 19 | 42537228 | 42537766 | 538 | loss | 1022 | HKR1 | N |
| 232 | 232 | 7 | 55855108 | 55873303 | 18195 | loss | 957 | SEPT14 | Y |
| 233 | 233 | 7 | 55878374 | 55890585 | 12211 | loss | 1003 | SEPT14 | Y |
| 234 | 234 | 7 | 23802428 | 23809398 | 6970 | loss | 993 | STK31 | N |
| 234 | 234 | 7 | 23802428 | 23809398 | 6970 | loss | 1004 | STK31 | N |
| 235 | 235 | 7 | 23802428 | 23809218 | 6790 | loss | 1009 | STK31 | N |
| 236 | 236 | 7 | 23802428 | 23811096 | 8668 | loss | 1013 | STK31 | N |
| 234 | 234 | 7 | 23802428 | 23809398 | 6970 | loss | 1022 | STK31 | N |
| 235 | 235 | 7 | 23802428 | 23809218 | 6790 | loss | 1036 | STK31 | N |
| 237 | 237 | 20 | 51045995 | 51058635 | 12640 | loss | 952 | TSHZ2 | N |
| 238 | 238 | 20 | 51053053 | 51054248 | 1195 | loss | 961 | TSHZ2 | N |
| 238 | 238 | 20 | 51053053 | 51054248 | 1195 | loss | 975 | TSHZ2 | N |
| 239 | 239 | 20 | 51053053 | 51058635 | 5582 | loss | 980 | TSHZ2 | N |
| 240 | 240 | 19 | 42386895 | 42388238 | 1343 | loss | 986 | ZNF585B | N |
| 240 | 240 | 19 | 42386895 | 42388238 | 1343 | loss | 1012 | ZNF585B | N |
| 240 | 240 | 19 | 42386895 | 42388238 | 1343 | loss | 1017 | ZNF585B | N |
| 240 | 240 | 19 | 42386895 | 42388238 | 1343 | loss | 1026 | ZNF585B | N |
| 241 | 241 | X | 39852030 | 39853092 | 1062 | gain | 970 | BCOR | N |
| 241 | 241 | X | 39852030 | 39853092 | 1062 | loss | 1016 | BCOR | N |
| 241 | 241 | X | 39852030 | 39853092 | 1062 | loss | 1031 | BCOR | N |
| 242 | 242 | 1 | 195559094 | 195562465 | 3371 | gain | 958 | CRB1 | N |
| 243 | 243 | 1 | 195561305 | 195562465 | 1160 | gain | 972 | CRB1 | N |
| 243 | 243 | 1 | 195561305 | 195562465 | 1160 | gain | 1002 | CRB1 | N |
| 244 | 244 | 3 | 172847008 | 172850471 | 3463 | gain | 994 | PLD1 | N |
| 245 | 245 | 3 | 173003698 | 173009667 | 5969 | loss | 991 | PLD1 | N |
| 246 | 246 | 3 | 173003698 | 173006873 | 3175 | loss | 1015 | PLD1 | N |
| 246 | 246 | 3 | 173003698 | 173006873 | 3175 | loss | 1022 | PLD1 | N |
| 247 | 247 | 8 | 18894239 | 18908287 | 14048 | gain | 949 | PSD3 | N |
| 247 | 247 | 8 | 18894239 | 18908287 | 14048 | gain | 985 | PSD3 | N |
| 247 | 247 | 8 | 18894239 | 18908287 | 14048 | gain | 1016 | PSD3 | N |
| 248 | 248 | 14 | 71779767 | 71780825 | 1058 | gain | 998 | RGS6 | N |
| 248 | 248 | 14 | 71779767 | 71780825 | 1058 | gain | 1016 | RGS6 | N |
| 248 | 248 | 14 | 71779767 | 71780825 | 1058 | gain | 1019 | RGS6 | N |
| 249 | 249 | 6 | 72916886 | 72924440 | 7554 | gain | 1029 | RIMS1 | N |
| 250 | 250 | 6 | 72920894 | 72931789 | 10895 | gain | 996 | RIMS1 | N |
| 251 | 251 | 17 | 16480516 | 16489447 | 8931 | loss | 975 | ZNF624 | N |
| 252 | 252 | 17 | 16480516 | 16483386 | 2870 | loss | 991 | ZNF624 | N |
| 252 | 252 | 17 | 16480516 | 16483386 | 2870 | loss | 1004 | ZNF624 | N |
| 253 | 253 | 12 | 42159304 | 42167699 | 8395 | loss | 946 | ADAMTS20 | N |
| 253 | 253 | 12 | 42159304 | 42167699 | 8395 | gain | 951 | ADAMTS20 | N |
| 254 | 254 | 1 | 6779563 | 6789223 | 9660 | gain | 973 | CAMTA1 | N |
| 255 | 255 | 1 | 6786219 | 6790460 | 4241 | gain | 962 | CAMTA1 | N |
| 256 | 256 | 1 | 7056961 | 7059582 | 2621 | gain | 1037 | CAMTA1 | N |
| 257 | 257 | 16 | 81590448 | 81599011 | 8563 | loss | 994 | CDH13 | N |
| 258 | 258 | 16 | 81592666 | 81599011 | 6345 | loss | 993 | CDH13 | N |
| 259 | 259 | 16 | 81752862 | 81755529 | 2667 | gain | 1025 | CDH13 | N |
| 259 | 259 | 16 | 81752862 | 81755529 | 2667 | gain | 1030 | CDH13 | N |
| 260 | 260 | 12 | 105959641 | 105980836 | 21195 | gain | 964 | CRY1 | N |
| 261 | 261 | 12 | 105966884 | 105967651 | 767 | gain | 950 | CRY1 | N |
| 262 | 262 | 7 | 101300618 | 101307173 | 6555 | loss | 1024 | CUX1 | N |
| 262 | 262 | 7 | 101300618 | 101307173 | 6555 | loss | 1026 | CUX1 | N |
| 263 | 263 | 19 | 15640597 | 15677382 | 36785 | gain | 1001 | CYP4F12 | Y |
| 264 | 264 | 19 | 15664290 | 15667581 | 3291 | gain | 950 | CYP4F12 | N |
| 265 | 265 | 8 | 1491491 | 1500993 | 9502 | gain | 998 | DLGAP2 | N |

TABLE 1-continued

| Priority Number | Seq ID | Chr | Start | Stop | Size | CNV Type | PD Case ID | RefSeq Gene Symbol | Exon overlap |
|---|---|---|---|---|---|---|---|---|---|
| 266 | 266 | 8 | 1496880 | 1499520 | 2640 | gain | 1012 | DLGAP2 | N |
| 267 | 267 | 2 | 153167113 | 153169656 | 2543 | gain | 962 | FMNL2 | N |
| 267 | 267 | 2 | 153167113 | 153169656 | 2543 | gain | 977 | FMNL2 | N |
| 268 | 268 | 5 | 90112791 | 90112816 | 25 | loss | 969 | GPR98 | N |
| 269 | 269 | 5 | 90254811 | 90261232 | 6421 | loss | 1015 | GPR98 | N |
| 269 | 269 | 5 | 90254811 | 90261232 | 6421 | loss | 1020 | GPR98 | N |
| 270 | 270 | 16 | 9962571 | 9968344 | 5773 | gain | 1032 | GRIN2A | N |
| 271 | 271 | 16 | 9965024 | 9968344 | 3320 | gain | 1001 | GRIN2A | N |
| 272 | 272 | 16 | 9979934 | 9981275 | 1341 | gain | 1032 | GRIN2A | N |
| 273 | 273 | 1 | 113847479 | 113848985 | 1506 | loss | 1016 | MAGI3 | N |
| 273 | 273 | 1 | 113847479 | 113848985 | 1506 | loss | 1036 | MAGI3 | N |
| 274 | 274 | 2 | 210019796 | 210021952 | 2156 | loss | 969 | MAP2 | N |
| 275 | 275 | 2 | 210089280 | 210092780 | 3500 | loss | 990 | MAP2 | N |
| 276 | 276 | 9 | 27323197 | 27324577 | 1380 | loss | 975 | MOB3B | N |
| 277 | 277 | 9 | 27365836 | 27367745 | 1909 | gain | 989 | MOB3B | N |
| 278 | 278 | 8 | 63429132 | 63445676 | 16544 | loss | 1003 | NKAIN3 | N |
| 279 | 279 | 8 | 63686220 | 63692725 | 6505 | loss | 992 | NKAIN3 | N |
| 279 | 279 | 8 | 63686220 | 63692725 | 6505 | loss | 999 | NKAIN3 | N |
| 280 | 280 | 14 | 78086003 | 78087442 | 1439 | gain | 971 | NRXN3 | N |
| 281 | 281 | 14 | 78227579 | 78233664 | 6085 | loss | 1002 | NRXN3 | N |
| 282 | 282 | 14 | 79127635 | 79134722 | 7087 | loss | 971 | NRXN3 | N |
| 283 | 283 | 14 | 79127635 | 79128659 | 1024 | loss | 986 | NRXN3 | N |
| 284 | 284 | 14 | 79174722 | 79183154 | 8432 | gain | 1035 | NRXN3 | N |
| 285 | 285 | 6 | 144006076 | 144011154 | 5078 | loss | 989 | PHACTR2 | N |
| 285 | 285 | 6 | 144006076 | 144011154 | 5078 | loss | 990 | PHACTR2 | N |
| 286 | 286 | 12 | 63346598 | 63347718 | 1120 | loss | 978 | RASSF3 | N |
| 287 | 287 | 12 | 63346598 | 63349229 | 2631 | loss | 987 | RASSF3 | N |
| 288 | 288 | 1 | 211441787 | 211462117 | 20330 | gain | 1027 | RPS6KC1 | N |
| 289 | 289 | 1 | 211453716 | 211460007 | 6291 | gain | 958 | RPS6KC1 | N |
| 290 | 290 | 11 | 13984290 | 13989127 | 4837 | loss | 995 | SPON1 | N |
| 290 | 290 | 11 | 13984290 | 13989127 | 4837 | loss | 996 | SPON1 | N |
| 291 | 291 | 3 | 122247183 | 122251797 | 4614 | loss | 990 | STXBP5L | N |
| 291 | 291 | 3 | 122247183 | 122251797 | 4614 | loss | 1033 | STXBP5L | N |
| 292 | 292 | 3 | 122473098 | 122479931 | 6833 | loss | 1004 | STXBP5L | N |
| 293 | 293 | 17 | 9267206 | 9269293 | 2087 | gain | 1027 | STX8 | N |
| 294 | 294 | 17 | 9269293 | 9272211 | 2918 | gain | 982 | STX8 | N |
| 295 | 295 | 12 | 77815879 | 77835641 | 19762 | loss | 1002 | SYT1 | N |
| 295 | 295 | 12 | 77815879 | 77835641 | 19762 | loss | 1015 | SYT1 | N |
| 296 | 296 | 12 | 6315047 | 6317276 | 2229 | loss | 1003 | TNFRSF1A | N |
| 296 | 296 | 12 | 6315047 | 6317276 | 2229 | loss | 1005 | TNFRSF1A | N |
| 297 | 297 | 2 | 54317909 | 54320610 | 2701 | gain | 962 | ACYP2 | N |
| 298 | 298 | 4 | 73518013 | 73522044 | 4031 | loss | 971 | ADAMTS3 | N |
| 299 | 299 | 4 | 73557728 | 73567966 | 10238 | loss | 1002 | ADAMTS3 | N |
| 300 | 300 | 7 | 97767682 | 97771031 | 3349 | gain | 986 | BAIAP2L1 | N |
| 301 | 301 | 7 | 97805256 | 97807057 | 1801 | gain | 989 | BAIAP2L1 | N |
| 302 | 302 | 11 | 47040725 | 47045421 | 4696 | loss | 1035 | C11orf49 | N |
| 303 | 303 | 11 | 47098212 | 47098992 | 780 | loss | 1017 | C11orf49 | N |
| 304 | 304 | 7 | 81791206 | 81794051 | 2845 | gain | 1019 | CACNA2D1 | N |
| 305 | 305 | 7 | 81792312 | 81794051 | 1739 | gain | 952 | CACNA2D1 | N |
| 305 | 305 | 7 | 81792312 | 81794051 | 1739 | gain | 989 | CACNA2D1 | N |
| 305 | 305 | 7 | 81792312 | 81794051 | 1739 | gain | 1002 | CACNA2D1 | N |
| 305 | 305 | 7 | 81792312 | 81794051 | 1739 | gain | 1009 | CACNA2D1 | N |
| 305 | 305 | 7 | 81792312 | 81794051 | 1739 | gain | 1016 | CACNA2D1 | N |
| 305 | 305 | 7 | 81792312 | 81794051 | 1739 | gain | 1022 | CACNA2D1 | N |
| 305 | 305 | 7 | 81792312 | 81794051 | 1739 | gain | 1026 | CACNA2D1 | N |
| 305 | 305 | 7 | 81792312 | 81794051 | 1739 | gain | 1036 | CACNA2D1 | N |
| 305 | 305 | 7 | 81792312 | 81794051 | 1739 | gain | 1037 | CACNA2D1 | N |
| 306 | 306 | 9 | 140136862 | 140145683 | 8821 | gain | 981 | CACNA1B | Y |
| 307 | 307 | 5 | 106844020 | 106849671 | 5651 | gain | 1015 | EFNA5 | N |
| 308 | 308 | 5 | 106868586 | 106875551 | 6965 | loss | 992 | EFNA5 | N |
| 309 | 309 | 3 | 89522996 | 89718542 | 195546 | gain | 960 | EPHA3 | Y |
| 310 | 310 | 2 | 154593217 | 154611228 | 18011 | gain | 950 | GALNT13 | N |
| 311 | 311 | 2 | 154915705 | 154919651 | 3946 | loss | 1022 | GALNT13 | N |
| 312 | 312 | 2 | 154953643 | 154955528 | 1885 | gain | 1037 | GALNT13 | N |
| 313 | 313 | 1 | 18377963 | 18381122 | 3159 | gain | 965 | IGSF21 | N |
| 314 | 314 | 1 | 18554390 | 18556733 | 2343 | loss | 966 | IGSF21 | N |
| 315 | 315 | 2 | 238217378 | 238224411 | 7033 | gain | 1010 | LRRFIP1 | N |
| 316 | 316 | 2 | 238219154 | 238224411 | 5257 | gain | 952 | LRRFIP1 | N |
| 316 | 316 | 2 | 238219154 | 238224411 | 5257 | gain | 966 | LRRFIP1 | N |
| 316 | 316 | 2 | 238219154 | 238224411 | 5257 | gain | 976 | LRRFIP1 | N |
| 316 | 316 | 2 | 238219154 | 238224411 | 5257 | gain | 978 | LRRFIP1 | N |
| 316 | 316 | 2 | 238219154 | 238224411 | 5257 | gain | 1002 | LRRFIP1 | N |
| 316 | 316 | 2 | 238219154 | 238224411 | 5257 | gain | 1014 | LRRFIP1 | N |
| 316 | 316 | 2 | 238219154 | 238224411 | 5257 | gain | 1034 | LRRFIP1 | N |
| 317 | 317 | X | 152978747 | 152981151 | 2404 | gain | 999 | MECP2 | N |
| 317 | 317 | X | 152978747 | 152981151 | 2404 | gain | 1022 | MECP2 | N |

TABLE 1-continued

| Priority Number | Seq ID | Chr | Start | Stop | Size | CNV Type | PD Case ID | RefSeq Gene Symbol | Exon overlap |
|---|---|---|---|---|---|---|---|---|---|
| 318 | 318 | 1 | 239259578 | 239489157 | 229579 | gain | 948 | MIR3123, RGS7 | Y |
| 319 | 319 | 19 | 3355220 | 3356334 | 1114 | gain | 949 | NFIC | N |
| 319 | 319 | 19 | 3355220 | 3356334 | 1114 | gain | 951 | NFIC | N |
| 319 | 319 | 19 | 3355220 | 3356334 | 1114 | gain | 954 | NFIC | N |
| 319 | 319 | 19 | 3355220 | 3356334 | 1114 | gain | 970 | NFIC | N |
| 319 | 319 | 19 | 3355220 | 3356334 | 1114 | gain | 978 | NFIC | N |
| 319 | 319 | 19 | 3355220 | 3356334 | 1114 | gain | 995 | NFIC | N |
| 319 | 319 | 19 | 3355220 | 3356334 | 1114 | gain | 1005 | NFIC | N |
| 319 | 319 | 19 | 3355220 | 3356334 | 1114 | gain | 1022 | NFIC | N |
| 319 | 319 | 19 | 3355220 | 3356334 | 1114 | gain | 1034 | NFIC | N |
| 320 | 320 | 9 | 8344218 | 8345409 | 1191 | gain | 993 | PTPRD | N |
| 321 | 321 | 9 | 9055746 | 9057345 | 1599 | loss | 1016 | PTPRD | N |
| 322 | 322 | 9 | 9675661 | 9679084 | 3423 | loss | 1036 | PTPRD | N |
| 323 | 323 | 9 | 10164640 | 10167989 | 3349 | gain | 950 | PTPRD | N |
| 324 | 324 | 9 | 10395198 | 10398529 | 3331 | loss | 1012 | PTPRD | N |
| 325 | 325 | 15 | 59220825 | 59234113 | 13288 | gain | 996 | RORA | N |
| 326 | 326 | 15 | 59220825 | 59221540 | 715 | gain | 998 | RORA | N |
| 327 | 327 | 5 | 77724204 | 77725392 | 1188 | gain | 948 | SCAMP1 | N |
| 327 | 327 | 5 | 77724204 | 77725392 | 1188 | gain | 950 | SCAMP1 | N |
| 327 | 327 | 5 | 77724204 | 77725392 | 1188 | gain | 955 | SCAMP1 | N |
| 327 | 327 | 5 | 77724204 | 77725392 | 1188 | gain | 957 | SCAMP1 | N |
| 327 | 327 | 5 | 77724204 | 77725392 | 1188 | gain | 958 | SCAMP1 | N |
| 327 | 327 | 5 | 77724204 | 77725392 | 1188 | gain | 970 | SCAMP1 | N |
| 327 | 327 | 5 | 77724204 | 77725392 | 1188 | gain | 978 | SCAMP1 | N |
| 327 | 327 | 5 | 77724204 | 77725392 | 1188 | gain | 988 | SCAMP1 | N |
| 327 | 327 | 5 | 77724204 | 77725392 | 1188 | gain | 995 | SCAMP1 | N |
| 327 | 327 | 5 | 77724204 | 77725392 | 1188 | gain | 1000 | SCAMP1 | N |
| 327 | 327 | 5 | 77724204 | 77725392 | 1188 | gain | 1002 | SCAMPI | N |
| 327 | 327 | 5 | 77724204 | 77725392 | 1188 | gain | 1028 | SCAMPI | N |
| 328 | 328 | 12 | 42909733 | 42912201 | 2468 | loss | 979 | TMEM117 | N |
| 329 | 329 | 12 | 42912202 | 42913523 | 1321 | loss | 1014 | TMEM117 | N |
| 330 | 330 | 3 | 11693583 | 11695234 | 1651 | loss | 974 | VGLL4 | N |
| 331 | 331 | 7 | 70311792 | 70316530 | 4738 | gain | 1019 | WBSCR17 | N |
| 332 | 332 | 7 | 70661573 | 70662760 | 1187 | loss | 978 | WBSCR17 | N |
| 333 | 333 | 1 | 68435695 | 68436445 | 750 | loss | 961 | WLS, GNG12-AS1 | N |
| 333 | 333 | 1 | 68435695 | 68436445 | 750 | loss | 971 | WLS, GNG12-AS1 | N |
| 333 | 333 | 1 | 68435695 | 68436445 | 750 | gain | 992 | WLS, GNG12-AS1 | N |
| 333 | 333 | 1 | 68435695 | 68436445 | 750 | loss | 997 | WLS, GNG12-AS1 | N |
| 333 | 333 | 1 | 68435695 | 68436445 | 750 | loss | 998 | WLS, GNG12-AS1 | N |
| 333 | 333 | 1 | 68435695 | 68436445 | 750 | gain | 999 | WLS, GNG12-AS1 | N |
| 333 | 333 | 1 | 68435695 | 68436445 | 750 | loss | 1011 | WLS, GNG12-AS1 | N |
| 333 | 333 | 1 | 68435695 | 68436445 | 750 | loss | 1013 | WLS, GNG12-AS1 | N |
| 334 | 334 | 1 | 68435695 | 68439703 | 4008 | loss | 1020 | WLS, GNG12-AS1 | N |
| 335 | 335 | 8 | 56318028 | 56321660 | 3632 | gain | 992 | XKR4 | N |
| 336 | 336 | 8 | 56363588 | 56368489 | 4901 | loss | 1028 | XKR4 | N |
| 337 | 337 | 5 | 172485049 | 172499213 | 14164 | gain | 958 | CREBRF | Y |
| 338 | 338 | 4 | 37191879 | 37278974 | 87095 | loss | 1011 | C4orf19, RELL1 | Y |
| 339 | 339 | 2 | 44392191 | 44488199 | 96008 | loss | 978 | CAMKMT, PREPL, SLC3A1 | Y |
| 340 | 340 | 12 | 122838898 | 122840411 | 1513 | loss | 975 | DNAH10 | Y |
| 341 | 341 | 3 | 57391544 | 57403468 | 11924 | loss | 986 | DNAH12 | Y |
| 342 | 342 | 6 | 38910371 | 38921613 | 11242 | gain | 957 | DNAH8 | Y |
| 343 | 343 | 5 | 138783067 | 138788669 | 5602 | gain | 1005 | DNAJC18 | Y |
| 344 | 344 | 3 | 60640025 | 60872007 | 231982 | loss | 967 | FHIT | Y |
| 345 | 345 | 3 | 189367406 | 189936236 | 568830 | gain | 971 | FLJ42393, LPP | Y |
| 346 | 346 | 22 | 20711753 | 21392867 | 681114 | loss | 963 | GGTLC2, LOC96610, PRAME, ZNF280B, ZNF280A, LOC648691, POM121L1P, VPREB1 | Y |
| 347 | 347 | 22 | 20716147 | 21576859 | 860712 | loss | 947 | GGTLC2, LOC96610, PRAME, IGLL5, ZNF280B, ZNF280A, LOC648691, POM121L1P, MIR650, VPREB1 | Y |
| 348 | 348 | 1 | 233606018 | 233781576 | 175558 | gain | 1018 | GNG4, TBCE, B3GALNT2 | Y |
| 349 | 349 | 6 | 87558407 | 87787539 | 229132 | gain | 980 | HTR1E | Y |
| 350 | 350 | 8 | 42308627 | 42312018 | 3391 | gain | 989 | IKBKB | Y |
| 351 | 351 | 16 | 31186841 | 31256185 | 69344 | gain | 1020 | ITGAM | Y |
| 352 | 352 | 1 | 153095163 | 153108159 | 12996 | gain | 950 | KCNN3 | Y |
| 353 | 353 | 2 | 143350188 | 143354905 | 4717 | loss | 1037 | KYNU | Y |
| 354 | 354 | 10 | 78775816 | 79543704 | 767888 | gain | 946 | LOC100128292, RPS24, DLG5, KCNMA1, POLR3A | Y |
| 355 | 355 | 8 | 142345181 | 142510717 | 165536 | gain | 1036 | LOC731779, GPR20, PTP4A3 | Y |
| 356 | 356 | 2 | 169872912 | 169890340 | 17428 | loss | 1037 | LRP2 | Y |

TABLE 1-continued

| Priority Number | Seq ID | Chr | Start | Stop | Size | CNV Type | PD Case ID | RefSeq Gene Symbol | Exon overlap |
|---|---|---|---|---|---|---|---|---|---|
| 357 | 357 | 12 | 38904346 | 38909561 | 5215 | gain | 972 | LRRK2 | Y |
| 358 | 358 | 8 | 17702372 | 17880477 | 178105 | loss | 976 | MTUS1, FGL1, PCM1 | Y |
| 359 | 359 | 2 | 170839943 | 170843170 | 3227 | gain | 955 | MYO3B | N |
| 360 | 360 | 2 | 170842044 | 170843170 | 1126 | loss | 1002 | MYO3B | N |
| 361 | 361 | 2 | 171074964 | 171076390 | 1426 | loss | 1007 | MYO3B | N |
| 362 | 362 | 2 | 171186115 | 171203861 | 17746 | gain | 959 | MYO3B | N |
| 363 | 363 | 2 | 171193428 | 171205175 | 11747 | gain | 1037 | MYO3B | N |
| 364 | 364 | 7 | 100622624 | 100660738 | 38114 | loss | 964 | PLOD3, ZNHIT1, MOGAT3 | Y |
| 365 | 365 | 6 | 149859127 | 149870155 | 11028 | loss | 1010 | PPIL4 | Y |
| 366 | 366 | 20 | 2873876 | 2879388 | 5512 | gain | 962 | PTPRA | Y |
| 367 | 367 | 1 | 196963584 | 196986393 | 22809 | loss | 1034 | PTPRC | Y |
| 368 | 368 | 4 | 2481647 | 2661045 | 179398 | loss | 969 | RNF4, FAM193A | Y |
| 369 | 369 | 18 | 16833161 | 16851074 | 17913 | gain | 965 | ROCK1 | Y |
| 370 | 370 | 6 | 125405845 | 125410165 | 4320 | loss | 1001 | RNF217 | Y |
| 371 | 371 | 8 | 41199070 | 41267922 | 68852 | gain | 996 | SFRP1 | Y |
| 372 | 372 | 6 | 43253688 | 43256242 | 2554 | loss | 1001 | SRF | Y |
| 373 | 373 | 15 | 72197969 | 72283889 | 85920 | gain | 1012 | STRA6, ISLR, ISLR2, LOC283731 | Y |
| 374 | 374 | 1 | 243943023 | 244875851 | 932828 | gain | 986 | TFB2M, CNST, LOC255654, SMYD3 | Y |
| 375 | 375 | 19 | 54388780 | 54397344 | 8564 | loss | 993 | TRPM4 | Y |
| 376 | 376 | 18 | 169042 | 184227 | 15185 | loss | 957 | USP14 | Y |
| 377 | 377 | 2 | 198356013 | 198386999 | 30986 | gain | 1036 | BOLL, PLCL1 | Y |
| 378 | 378 | 12 | 63107981 | 63136048 | 28067 | gain | 1027 | XPOT, TBK1 | Y |
| 379 | 379 | 6 | 135696211 | 136199542 | 503331 | loss | 1024 | LINC00271, AHI1, MIR548H4 | Y |
| 380 | 380 | 16 | 71619180 | 72163605 | 544425 | gain | 1011 | LOC100506172, HTA, ZFHX3 | Y |
| 381 | 381 | 7 | 18161134 | 18275401 | 114267 | loss | 971 | HDAC9 | Y |
| 382 | 382 | 21 | 38314286 | 38675904 | 361618 | gain | 1015 | DSCR4, ERG, DSCR8, KCNJ15, DSCR10 | Y |

TABLE 2

| Sub region ID # | Chr | Start | Stop | Size (bp) | PD Case ID | GeneNames | Exon overlap |
|---|---|---|---|---|---|---|---|
| 1 | 1 | 1707874 | 1914525 | 206651 | 1020 | KIAA1751, TMEM52, GNB1, CALML6 | Y |
| 2 | 1 | 6779563 | 6786218 | 6655 | 973 | CAMTA1 | N |
| 3 | 1 | 6786219 | 6789223 | 3004 | 962; 973 | CAMTA1 | N |
| 4 | 1 | 6789224 | 6790460 | 1236 | 962 | CAMTA1 | N |
| 5 | 1 | 7056961 | 7059582 | 2621 | 1037 | CAMTA1 | N |
| 6 | 1 | 18377963 | 18381122 | 3159 | 965 | IGSF21 | N |
| 7 | 1 | 18554390 | 18556733 | 2343 | 966 | IGSF21 | N |
| 8 | 1 | 68435695 | 68436445 | 750 | 961; 971; 992; 997; 998; 999; 1011; 1013; 1020 | WLS, GNG12-AS1 | N |
| 9 | 1 | 68436446 | 68439703 | 3257 | 1020 | WLS, GNG12-AS1 | N |
| 10 | 1 | 74271266 | 74334696 | 63430 | 2544 | LRRIQ3 | Y |
| 11 | 1 | 74359462 | 74372201 | 12739 | 2222 | LRRIQ3 | N |
| 12 | 1 | 74361348 | 74372201 | 10853 | 968; 1010; 1029 | LRRIQ3 | N |
| 13 | 1 | 74421868 | 74434506 | 12638 | 2539 | LRRIQ3 | Y |
| 13 | 1 | 74421868 | 74434506 | 12638 | 2610 | LRRIQ3 | Y |
| 14 | 1 | 85964576 | 85967615 | 3039 | 948; 984; 991; 993; 994; 998; 1005; 1009; 1010; 1011; 1013; 1014; 1015; 1020 | COL24A1 | Y |
| 15 | 1 | 103839772 | 103899770 | 59998 | 998 | AMY2B, RNPC3 | Y |
| 16 | 1 | 103899771 | 103901453 | 1682 | 998; 1003 | AMY2B | N |
| 17 | 1 | 103901454 | 103904722 | 3268 | 998; 1003; 1027 | AMY2B | N |
| 18 | 1 | 108538663 | 108543860 | 5197 | 959; 1029 | SLC25A24 | N |
| 19 | 1 | 113847479 | 113848985 | 1506 | 1016; 1036 | MAGI3 | N |
| 20 | 1 | 153095163 | 153108159 | 12996 | 950 | KCNN3 | Y |
| 21 | 1 | 194977713 | 194978217 | 504 | 1001; 1028 | CFH | Y |
| 22 | 1 | 194978218 | 195009357 | 31139 | 961; 990; 996; 1001; 1028 | CFH | N |
| 23 | 1 | 195559094 | 195562465 | 3371 | 958; 972; 1002 | CRB1 | N |
| 24 | 1 | 196963584 | 196986393 | 22809 | 1034 | PTPRC | Y |
| 25 | 1 | 204497847 | 204637883 | 140036 | 988; 990 | CTSE, SRGAP2 | Y |
| 26 | 1 | 211022043 | 211027746 | 5703 | 1001; 1036 | NSL1 | Y |
| 27 | 1 | 211441787 | 211453715 | 11928 | 1027 | RPS6KC1 | N |
| 28 | 1 | 211453716 | 211460007 | 6291 | 958; 1027 | RPS6KC1 | N |
| 29 | 1 | 211460008 | 211462117 | 2109 | 1027 | RPS6KC1 | N |
| 30 | 1 | 233606018 | 233781576 | 175558 | 1018 | GNG4, TBCE, B3GALNT2 | Y |

TABLE 2-continued

| Sub region ID # | Chr | Start | Stop | Size (bp) | PD Case ID | GeneNames | Exon overlap |
|---|---|---|---|---|---|---|---|
| 31 | 1 | 239259578 | 239489157 | 229579 | 948 | MIRR3123, RGS7 | Y |
| 32 | 1 | 243943023 | 244875851 | 932828 | 986 | TFB2M, CNST, LOC255654, SMYD3 | Y |
| 33 | 2 | 3708749 | 3713663 | 4914 | 995; 1001; 1018; 1019 | ALLC | N |
| 34 | 2 | 44398520 | 44488199 | 89679 | 978 | CAMKMT, PREPL, SLC3A1 | Y |
| 35 | 2 | 54308895 | 54317908 | 9013 | 983 | ACYP2 | N |
| 36 | 2 | 54317909 | 54320610 | 2701 | 962 | ACYP2 | N |
| 36 | 2 | 54317909 | 54320610 | 2701 | 962; 983 | ACYP2 | N |
| 37 | 2 | 54320611 | 54356768 | 36157 | 983 | TSPYL6, ACYP2 | Y |
| 38 | 2 | 112750646 | 112761949 | 11303 | 996; 1022 | ZC3H6 | N |
| 39 | 2 | 112752277 | 112761949 | 9672 | 2327 | ZC3H6 | N |
| 39 | 2 | 112752277 | 112761949 | 9672 | 2342 | ZC3H6 | N |
| 39 | 2 | 112752277 | 112761949 | 9672 | 2360 | ZC3H6 | N |
| 39 | 2 | 112752277 | 112761949 | 9672 | 2426 | ZC3H6 | N |
| 39 | 2 | 112752277 | 112761949 | 9672 | 2515 | ZC3H6 | N |
| 39 | 2 | 112752277 | 112761949 | 9672 | 2587 | ZC3H6 | N |
| 40 | 2 | 143350188 | 143354905 | 4717 | 1037 | KYNU | Y |
| 41 | 2 | 153167113 | 153168325 | 1212 | 962; 977 | FMNL2 | N |
| 42 | 2 | 154593217 | 154605620 | 12403 | 950 | GALNT13 | N |
| 43 | 2 | 154915705 | 154919651 | 3946 | 1022 | GALNT13 | N |
| 44 | 2 | 154953643 | 154955528 | 1885 | 1037 | GALNT13 | N |
| 45 | 2 | 169872912 | 169890340 | 17428 | 1037 | LRP2 | Y |
| 46 | 2 | 170842044 | 170843170 | 1126 | 955; 1002 | MYO3B | N |
| 47 | 2 | 171074964 | 171076390 | 1426 | 1007 | MYO3B | N |
| 48 | 2 | 171186115 | 171193427 | 7312 | 959 | MYO3B | N |
| 49 | 2 | 171193428 | 171203861 | 10433 | 959; 1037 | MYO3B | N |
| 50 | 2 | 171203862 | 171205175 | 1313 | 1037 | MYO3B | N |
| 51 | 2 | 198356013 | 198386999 | 30986 | 1036 | BOLL, PLCL1 | Y |
| 52 | 2 | 198497294 | 198505239 | 7945 | 2190 | PLCL1 | N |
| 52 | 2 | 198497294 | 198505239 | 7945 | 2298 | PLCL1 | N |
| 52 | 2 | 198497294 | 198505239 | 7945 | 2575 | PLCL1 | N |
| 53 | 2 | 210019796 | 210021952 | 2156 | 969 | MAP2 | N |
| 54 | 2 | 210089280 | 210092780 | 3500 | 990 | MAP2 | N |
| 55 | 2 | 214581782 | 214582920 | 1138 | 993 | SPAG16 | N |
| 56 | 2 | 214584322 | 214586936 | 2614 | 993 | SPAG16 | Y |
| 57 | 2 | 214805561 | 214807910 | 2349 | 1018 | SPAG16 | N |
| 58 | 2 | 214886207 | 214887681 | 1474 | 999 | SPAG16 | N |
| 59 | 2 | 238217378 | 238219153 | 1775 | 1010 | LRRFIP1 | N |
| 60 | 2 | 238223193 | 238224411 | 1218 | 952; 966; 976; 978; 1002; 1010; 1014; 1034 | LRRFIP1 | N |
| 61 | 3 | 11693583 | 11695234 | 1651 | 974 | VGLL4 | N |
| 62 | 3 | 11705809 | 11869809 | 164000 | 989 | TAMM41, VGLL4 | Y |
| 63 | 3 | 30711659 | 30768467 | 56808 | 2613 | GADL1 | Y |
| 64 | 3 | 30739769 | 30743172 | 3403 | 1017; 1025 | GADL1 | Y |
| 65 | 3 | 30743173 | 30748426 | 5253 | 978; 1017; 1025 | GADL1 | Y |
| 66 | 3 | 30748427 | 30751038 | 2611 | 1017 | GADL1 | N |
| 67 | 3 | 30768468 | 30770607 | 2139 | 2577 | GADL1 | N |
| 67 | 3 | 30768468 | 30770607 | 2139 | 2613 | GADL1 | N |
| 68 | 3 | 30770608 | 30807514 | 36906 | 2613 | GADL1 | Y |
| 69 | 3 | 30845814 | 30896445 | 50631 | 2603 | GADL1 | Y |
| 70 | 3 | 55514618 | 55517737 | 3119 | 969; 999; 1005 | ERC2 | Y |
| 71 | 3 | 57391544 | 57403468 | 11924 | 986 | DNAH12 | Y |
| 72 | 3 | 60640025 | 60872007 | 231982 | 967 | FRIT | Y |
| 73 | 3 | 60774433 | 60817887 | 43454 | 967 | FRIT | Y |
| 74 | 3 | 89522996 | 89616359 | 93363 | 960 | EPHA3 | Y |
| 75 | 3 | 115911311 | 115919955 | 8644 | 1034; 1036 | ZBTB20 | Y |
| 76 | 3 | 122247183 | 122251797 | 4614 | 990;1033 | STXBP5L | N |
| 77 | 3 | 122473098 | 122479931 | 6833 | 1004 | STXBP5L | N |
| 78 | 3 | 172847008 | 172850471 | 3463 | 994 | PLD1 | N |
| 79 | 3 | 173003698 | 173005242 | 1544 | 991; 1015; 1022 | PLD1 | N |
| 80 | 3 | 173006874 | 173009667 | 2793 | 991 | PLD1 | N |
| 81 | 3 | 174698474 | 174701950 | 3476 | 952; 975; 978; 1020; 1022; 1034 | NLGN1 | N |
| 82 | 3 | 174701951 | 174704469 | 2518 | 975; 978; 1020; 1022; 1034 | NLGN1 | N |
| 83 | 3 | 174704470 | 174706670 | 2200 | 1020; 1034 | NLGN1 | N |
| 84 | 3 | 174706671 | 174708603 | 1932 | 1034 | NLGN1 | N |
| 85 | 3 | 189753649 | 189936236 | 182587 | 971 | LPP | Y |
| 86 | 3 | 193372894 | 193374127 | 1233 | 1016 | FGF12 | N |
| 87 | 3 | 193472185 | 193478807 | 6622 | 2053 | FGF12 | N |
| 87 | 3 | 193472185 | 193478807 | 6622 | 2418 | FGF12 | N |
| 87 | 3 | 193472185 | 193478807 | 6622 | 2427 | FGF12 | N |
| 87 | 3 | 193472185 | 193478807 | 6622 | 2450 | FGF12 | N |
| 88 | 3 | 193678496 | 193680012 | 1516 | 1029 | FGF12 | N |
| 89 | 3 | 193785530 | 193787654 | 2124 | 1030 | FGF12 | N |
| 90 | 3 | 193794412 | 193797190 | 2778 | 947; 959 | FGF12 | N |
| 91 | 3 | 198036999 | 198041361 | 4362 | 948; 950; 951; 1020; 1034 | PAK2 | Y |
| 92 | 3 | 198042682 | 198125625 | 82943 | 948; 950; 951; 1020; 1034 | SENP5, PAK2 | Y |

TABLE 2-continued

| Sub region ID # | Chr | Start | Stop | Size (bp) | PD Case ID | GeneNames | Exon overlap |
|---|---|---|---|---|---|---|---|
| 93 | 3 | 198119175 | 198124199 | 5024 | 2322 | SENP5 | N |
| 93 | 3 | 198119175 | 198124199 | 5024 | 2345 | SENP5 | N |
| 93 | 3 | 198119175 | 198124199 | 5024 | 2366 | SENP5 | N |
| 93 | 3 | 198119175 | 198124199 | 5024 | 2427 | SENP5 | N |
| 94 | 3 | 198177030 | 198187875 | 10845 | 967; 975 | PIGZ | Y |
| 95 | 3 | 199030475 | 199032254 | 1779 | 967 | LRCH3 | Y |
| 96 | 3 | 199033913 | 199038162 | 4249 | 948; 967; 1007; 1011; 1031 | LRCH3 | Y |
| 97 | 3 | 199081462 | 199187361 | 105899 | 948; 952; 967; 970; 974; 1007; 1011; 1031; 1034 | LMLN, IQCG, RPL35A, LRCH3 | Y |
| 98 | 3 | 199187362 | 199188547 | 1185 | 948; 952; 967; 970; 974; 1007; 1011; 1031 | LMLN | Y |
| 99 | 4 | 2483395 | 2529866 | 46471 | 969 | RNF4 | Y |
| 100 | 4 | 37191879 | 37278974 | 87095 | 1011 | C4orf19, RELL1 | Y |
| 101 | 4 | 47314693 | 47323346 | 8653 | 1033 | CORIN | Y |
| 102 | 4 | 47361851 | 47362999 | 1148 | 978 | CORIN | Y |
| 103 | 4 | 57739809 | 57742530 | 2721 | 976; 986; 1029 | LOC255130 | N |
| 104 | 4 | 57742531 | 57745126 | 2595 | 951; 976; 986; 1019; 1029 | LOC255130 | N |
| 105 | 4 | 73518013 | 73522044 | 4031 | 971 | ADAMTS3 | N |
| 106 | 4 | 73557728 | 73567966 | 10238 | 1002 | ADAMTS3 | N |
| 107 | 4 | 103310758 | 103960183 | 649425 | 965 | SLC39A8, NFKB1, UBE2D3, MANBA | Y |
| 108 | 4 | 103960184 | 103968003 | 7819 | 965; 989 | UBE2D3 | Y |
| 109 | 4 | 104002633 | 104753531 | 750898 | 965 | CISD2, TACR3, CENPE, UBE2D3, SLC9B1, SLC9B2, BDH2 | Y |
| 110 | 5 | 33493254 | 33494402 | 1148 | 992; 1013 | TARS | Y |
| 111 | 5 | 44280749 | 44389035 | 108286 | 966 | FGF10 | Y |
| 112 | 5 | 77724204 | 77725392 | 1188 | 948; 950; 955; 957; 958; 970; 978; 988; 995; 1000; 1002; 1028 | SCAMP1 | N |
| 113 | 5 | 90112791 | 90112816 | 25 | 969 | GPR98 | N |
| 114 | 5 | 90254811 | 90261232 | 6421 | 1015; 1020 | GPR98 | N |
| 115 | 5 | 106844020 | 106849671 | 5651 | 1015 | EFNA5 | N |
| 116 | 5 | 106868586 | 106875551 | 6965 | 992 | EFNA5 | N |
| 117 | 5 | 126784243 | 126786973 | 2730 | 1013 | MEGF10 | Y |
| 118 | 5 | 126786974 | 126788155 | 1181 | 986; 1012; 1013 | MEGF10 | N |
| 119 | 5 | 127434789 | 127436376 | 1587 | 2315 | FLJ33630 | N |
| 119 | 5 | 127434789 | 127436376 | 1587 | 2350 | FLJ33630 | N |
| 119 | 5 | 127434789 | 127436376 | 1587 | 2563 | FLJ33630 | N |
| 120 | 5 | 127438119 | 127439603 | 1484 | 990; 1029 | FLJ33630 | N |
| 121 | 5 | 127439604 | 127443917 | 4313 | 1029 | FLJ33630 | N |
| 122 | 5 | 134286886 | 134289928 | 3042 | 961; 975; 993; 1030 | PCBD2 | N |
| 123 | 5 | 138783067 | 138788669 | 5602 | 1005 | DNAJC18 | Y |
| 124 | 5 | 140216525 | 140219465 | 2940 | 1004; 1024; 1034 | PCDHA2, PCDHA3, PCDHA1, PCDHA6, PCDHA7, PCDHA4, PCDHA5, PCDHA8, PCDHA9, PCDHA10 | Y |
| 125 | 5 | 145597802 | 145602068 | 4266 | 980 | RBM27 | N |
| 126 | 5 | 145627474 | 145628667 | 1193 | 950; 1004 | RBM27 | Y |
| 127 | 5 | 145628668 | 145645004 | 16336 | 950 | RBM27 | Y |
| 128 | 5 | 150082708 | 150087911 | 5203 | 964 | DCTN4 | Y |
| 129 | 5 | 150084557 | 150086690 | 2133 | 971 | DCTN4 | N |
| 129 | 5 | 150084557 | 150086690 | 2133 | 964; 971 | DCTN4 | N |
| 130 | 5 | 171229766 | 171231310 | 1544 | 967 | FBXW11 | Y |
| 131 | 5 | 171335918 | 171339127 | 3209 | 971 | FBXW11 | N |
| 132 | 5 | 172485049 | 172499213 | 14164 | 958 | CREBRF | Y |
| 133 | 5 | 179430821 | 179431937 | 1116 | 947; 953; 955; 957; 958; 959; 960; 971; 977; 982; 997; 1001; 1003; 1006; 1031; 1033 | RNF130 | Y |
| 134 | 6 | 18532373 | 18534548 | 2175 | 2372 | RNF144B | N |
| 134 | 6 | 18532373 | 18534548 | 2175 | 2620 | RNF144B | N |
| 134 | 6 | 18532373 | 18534548 | 2175 | 2629 | RNF144B | N |
| 135 | 6 | 18574467 | 18576632 | 2165 | 1024 | RNF144B | Y |
| 136 | 6 | 38910371 | 38921613 | 11242 | 957 | DNAH8 | Y |
| 137 | 6 | 43253688 | 43256242 | 2554 | 1001 | SRF | Y |
| 138 | 6 | 72916886 | 72917266 | 380 | 1029 | RIMS1 | N |
| 139 | 6 | 72931543 | 72931789 | 246 | 996 | RIMS1 | N |
| 140 | 6 | 87558407 | 87787539 | 229132 | 980 | HTR1E | Y |
| 141 | 6 | 125405845 | 125410165 | 4320 | 1001 | RNF217 | Y |
| 142 | 6 | 133004187 | 133008146 | 3959 | 1017 | TAAR1 | Y |
| 143 | 6 | 134624093 | 134631700 | 7607 | 953; 957; 963; 981; 984; 1003; 1005 | SGK1 | Y |
| 144 | 6 | 135696211 | 135794161 | 97950 | 1024 | AHI1, MIR548H4 | Y |
| 145 | 6 | 135797170 | 135954136 | 156966 | 1024 | LINC00271, AHI1, MIR548H4 | Y |
| 146 | 6 | 144006076 | 144011154 | 5078 | 989; 990 | PHACTR2 | N |
| 147 | 6 | 149859127 | 149870155 | 11028 | 1010 | PPIL4 | Y |
| 148 | 6 | 151310683 | 151312867 | 2184 | 992 | MTHFD1L | Y |
| 149 | 6 | 151314466 | 151317012 | 2546 | 2342 | MTHFD1L | N |

TABLE 2-continued

| Sub region ID # | Chr | Start | Stop | Size (bp) | PD Case ID | GeneNames | Exon over-lap |
|---|---|---|---|---|---|---|---|
| 149 | 6 | 151314466 | 151317012 | 2546 | 2583 | MTHFD1L | N |
| 149 | 6 | 151314466 | 151317012 | 2546 | 2631 | MTHFD1L | N |
| 150 | 6 | 151314466 | 151318805 | 4339 | 992; 1013 | MTHFD1L | Y |
| 151 | 6 | 160246670 | 160248266 | 1596 | 986; 1031 | MAS1 | Y |
| 152 | 7 | 14179928 | 14185615 | 5687 | 989 | DGKB | Y |
| 153 | 7 | 14727426 | 14731583 | 4157 | 977 | DGKB | N |
| 154 | 7 | 18161134 | 18275401 | 114267 | 971 | HDAC9 | Y |
| 155 | 7 | 23802428 | 23809218 | 6790 | 993; 1004; 1009; 1013; 1022; 1036 | STK31 | N |
| 156 | 7 | 23809219 | 23809398 | 179 | 993; 1004; 1013; 1022 | STK31 | N |
| 157 | 7 | 23809399 | 23811096 | 1697 | 1013 | STK31 | N |
| 158 | 7 | 43804939 | 43807655 | 2716 | 1016 | BLVRA | Y |
| 159 | 7 | 43809288 | 43810836 | 1548 | 1004 | BLVRA | Y |
| 160 | 7 | 55855108 | 55873303 | 18195 | 957 | SEPT14 | Y |
| 161 | 7 | 55878374 | 55890585 | 12211 | 1003 | SEPT14 | Y |
| 162 | 7 | 70311792 | 70316530 | 4738 | 1019 | WBSCR17 | N |
| 163 | 7 | 70661573 | 70662760 | 1187 | 978 | WBSCR17 | N |
| 164 | 7 | 81791206 | 81792311 | 1105 | 1019 | CACNA2D1 | N |
| 165 | 7 | 81792312 | 81794051 | 1739 | 952; 989; 1002; 1009; 1016; 1019; 1022; 1026; 1036; 1037 | CACNA2D1 | N |
| 166 | 7 | 97767682 | 97771031 | 3349 | 986 | BAIAP2L1 | N |
| 167 | 7 | 97805256 | 97807057 | 1801 | 983; 989 | BAIAP2L1 | N |
| 168 | 7 | 100622624 | 100660738 | 38114 | 964 | PLOD3, ZNHIT1, MOGAT3 | Y |
| 169 | 7 | 101300618 | 101307173 | 6555 | 1024; 1026 | CUX1 | N |
| 170 | 7 | 133903992 | 133913921 | 9929 | 983 | AKR1B15 | Y |
| 171 | 7 | 133906667 | 133910372 | 3705 | 1032 | AKR1B15 | Y |
| 171 | 7 | 133906667 | 133910372 | 3705 | 983; 1032 | AKR1B15 | Y |
| 172 | 7 | 141440185 | 141442231 | 2046 | 999; 1030 | MGAM | Y |
| 173 | 7 | 146842506 | 146844392 | 1886 | 2306 | CNTNAP2 | N |
| 173 | 7 | 146842506 | 146844392 | 1886 | 2408 | CNTNAP2 | N |
| 173 | 7 | 146842506 | 146844392 | 1886 | 2608 | CNTNAP2 | N |
| 174 | 7 | 147441927 | 147443119 | 1192 | 2266 | MIR548T, CNTNAP2 | N |
| 174 | 7 | 147441927 | 147443119 | 1192 | 2269 | MIR548T, CNTNAP2 | N |
| 174 | 7 | 147441927 | 147443119 | 1192 | 2320 | MIR548T, CNTNAP2 | N |
| 174 | 7 | 147441927 | 147443119 | 1192 | 2436 | MIR548T, CNTNAP2 | N |
| 174 | 7 | 147441927 | 147443119 | 1192 | 2443 | MIR548T, CNTNAP2 | N |
| 174 | 7 | 147441927 | 147443119 | 1192 | 2565 | MIR548T, CNTNAP2 | N |
| 174 | 7 | 147441927 | 147443119 | 1192 | 2593 | MIR548T, CNTNAP2 | N |
| 175 | 7 | 147708383 | 147710037 | 1654 | 994; 1017; 1018 | CNTNAP2 | N |
| 176 | 7 | 151728812 | 151730249 | 1437 | 950; 958; 967; 995; 1002; 1019 | MLL3 | N |
| 177 | 7 | 153645525 | 153647352 | 1827 | 2050 | DPP6 | N |
| 177 | 7 | 153645525 | 153647352 | 1827 | 2461 | DPP6 | N |
| 177 | 7 | 153645525 | 153647352 | 1827 | 2521 | DPP6 | N |
| 178 | 7 | 153901057 | 154002117 | 101060 | 957 | DPP6 | N |
| 179 | 7 | 154028650 | 154032130 | 3480 | 969; 993; 1031 | DPP6 | N |
| 180 | 7 | 156485711 | 156490484 | 4773 | 1014; 1016 | MNX1 | Y |
| 181 | 7 | 156490485 | 156495904 | 5419 | 1014 | MNX1 | Y |
| 182 | 8 | 1491491 | 1496879 | 5388 | 998 | DLGAP2 | N |
| 183 | 8 | 1496880 | 1499520 | 2640 | 998; 1012 | DLGAP2 | N |
| 184 | 8 | 1499521 | 1500993 | 1472 | 998 | DLGAP2 | N |
| 185 | 8 | 17860007 | 17880477 | 20470 | 976 | PCM1 | Y |
| 186 | 8 | 18894239 | 18896031 | 1792 | 949; 985; 1016 | PSD3 | N |
| 187 | 8 | 31639124 | 31642682 | 3558 | 1029 | NRG1 | N |
| 188 | 8 | 31811829 | 31814233 | 2404 | 1034 | NRG1 | N |
| 189 | 8 | 31814234 | 31815721 | 1487 | 1017; 1034 | NRG1 | N |
| 190 | 8 | 32551972 | 32553445 | 1473 | 1029 | NRG1 | N |
| 191 | 8 | 37754788 | 37755937 | 1149 | 946; 1007 | PROSC | Y |
| 192 | 8 | 41199070 | 41267922 | 68852 | 996 | SFRP1 | Y |
| 193 | 8 | 42308627 | 42312018 | 3391 | 989 | IKBKB | Y |
| 194 | 8 | 56318028 | 56321660 | 3632 | 992 | XKR4 | N |
| 195 | 8 | 56363588 | 56368489 | 4901 | 1028 | XKR4 | N |
| 196 | 8 | 63429132 | 63440428 | 11296 | 1003 | NKAIN3 | N |
| 197 | 8 | 63686220 | 63692725 | 6505 | 992; 999 | NKAIN3 | N |
| 198 | 8 | 74526051 | 74527806 | 1755 | 1032 | STAU2 | N |
| 199 | 8 | 74753948 | 74761544 | 7596 | 992 | STAU2 | N |
| 200 | 8 | 74761545 | 74778653 | 17108 | 1012 | STAU2 | Y |
| 201 | 8 | 85403103 | 85404716 | 1613 | 954 | RALYL | N |
| 202 | 8 | 85418745 | 85420036 | 1291 | 1037 | RALYL | N |
| 203 | 8 | 85420037 | 85422156 | 2119 | 1024; 1037 | RALYL | Y |
| 204 | 8 | 85422157 | 85423937 | 1780 | 957; 992; 997; 1000; 1003; 1024; 1028; 1030; 1037 | RALYL | N |
| 205 | 8 | 85839690 | 85842807 | 3117 | 949 | RALYL | N |
| 206 | 8 | 88382155 | 88388307 | 6152 | 964; 971; 975; 990 | CNBD1 | N |
| 207 | 8 | 94041443 | 94043276 | 1833 | 1025 | TRIQK | N |
| 208 | 8 | 94043277 | 94045697 | 2420 | 1018; 1025 | TRIQK | N |

TABLE 2-continued

| Sub region ID # | Chr | Start | Stop | Size (bp) | PD Case ID | GeneNames | Exon overlap |
|---|---|---|---|---|---|---|---|
| 209 | 8 | 94045698 | 94059962 | 14264 | 1025 | TRIQK | Y |
| 210 | 8 | 99038720 | 99039951 | 1231 | 1004 | MATN2 | N |
| 211 | 8 | 99039952 | 99041695 | 1743 | 968; 975; 993; 1004 | MATN2 | N |
| 212 | 8 | 142422281 | 142510717 | 88436 | 1036 | LOC731779, GPR20, PTP4A3 | Y |
| 213 | 8 | 144845724 | 144863110 | 17386 | 1008; 1024 | BREA2, ZNF707, CCDC166 | Y |
| 214 | 8 | 144970607 | 144970777 | 170 | 946; 949; 961; 968; 974; 975; 1034 | PUF60 | Y |
| 215 | 9 | 8344218 | 8345409 | 1191 | 993 | PTPRD | N |
| 216 | 9 | 9055746 | 9057345 | 1599 | 1016 | PTPRD | N |
| 217 | 9 | 9675661 | 9679084 | 3423 | 1036 | PTPRD | N |
| 218 | 9 | 10164640 | 10167989 | 3349 | 950 | PTPRD | N |
| 219 | 9 | 10395198 | 10398529 | 3331 | 1012 | PTPRD | N |
| 220 | 9 | 27323197 | 27324577 | 1380 | 975 | MOB3B | N |
| 221 | 9 | 27365836 | 27367745 | 1909 | 989 | MOB3B | N |
| 222 | 9 | 39062211 | 39091348 | 29137 | 966; 967; 975; 980; 982; 992; 994 | CNTNAP3 | Y |
| 223 | 9 | 39091349 | 39130210 | 38861 | 966; 967; 970; 975; 980; 982; 992; 994 | CNTNAP3 | Y |
| 224 | 9 | 98831789 | 98831814 | 25 | 999; 1018 | CTSL2 | Y |
| 225 | 9 | 140136862 | 140145631 | 8769 | 981 | CACNA1B | Y |
| 226 | 10 | 5965889 | 5979771 | 13882 | 992 | ANKRD16, FBXO18 | Y |
| 227 | 10 | 5979772 | 5984216 | 4444 | 992; 1030 | FBXO18 | N |
| 228 | 10 | 5984217 | 5985729 | 1512 | 1030; 1037 | FBXO18 | Y |
| 229 | 10 | 5984217 | 5995714 | 11497 | 992; 1030; 1037 | FBXO18 | Y |
| 230 | 10 | 5985730 | 5988631 | 2901 | 1000; 1030; 1037 | FBXO18 | Y |
| 231 | 10 | 5988632 | 5995714 | 7082 | 1030; 1037 | FBXO18 | Y |
| 232 | 10 | 60139394 | 60189880 | 50486 | 992 | FAM133CP, BICC1 | Y |
| 233 | 10 | 60191123 | 60201113 | 9990 | 992 | BICC1 | N |
| 234 | 10 | 76129083 | 76135755 | 6672 | 955; 959; 964; 988; 1007 | ADK | N |
| 235 | 10 | 78775816 | 79199560 | 423744 | 946 | KCNMA1 | Y |
| 236 | 10 | 79201984 | 79543704 | 341720 | 946 | L0C100128292, RPS24, DLG5, POLR3A | Y |
| 237 | 10 | 84165642 | 84171045 | 5403 | 988 | NRG3 | N |
| 238 | 10 | 84188750 | 84190301 | 1551 | 977 | NRG3 | N |
| 239 | 10 | 88905200 | 89245881 | 340681 | 969; 999 | LOC439994, FAM22D, FAM22A, LOC728190, LOC728218, FAM35A | Y |
| 240 | 10 | 95534054 | 95536083 | 2029 | 952; 961; 968 | LGI1 | N |
| 241 | 10 | 117226301 | 117232646 | 6345 | 1004; 1010 | ATRNL1 | N |
| 242 | 10 | 117338366 | 117339297 | 931 | 2294 | ATRNL1 | N |
| 242 | 10 | 117338366 | 117339297 | 931 | 2332 | ATRNL1 | N |
| 242 | 10 | 117338366 | 117339297 | 931 | 2337 | ATRNL1 | N |
| 242 | 10 | 117338366 | 117339297 | 931 | 2404 | ATRNL1 | N |
| 242 | 10 | 117338366 | 117339297 | 931 | 2405 | ATRNL1 | N |
| 242 | 10 | 117338366 | 117339297 | 931 | 2447 | ATRNL1 | N |
| 242 | 10 | 117338366 | 117339297 | 931 | 2481 | ATRNL1 | N |
| 242 | 10 | 117338366 | 117339297 | 931 | 2610 | ATRNL1 | N |
| 242 | 10 | 117338366 | 117339297 | 931 | 2614 | ATRNL1 | N |
| 242 | 10 | 117338366 | 117339297 | 931 | 2628 | ATRNL1 | N |
| 243 | 10 | 122623381 | 122626509 | 3128 | 966 | WDR11, M1R5694 | Y |
| 244 | 10 | 122633344 | 122640560 | 7216 | 950 | WDR11, M1R5694 | Y |
| 245 | 11 | 13984290 | 13989127 | 4837 | 995; 996 | SPON1 | N |
| 246 | 11 | 47040725 | 47045421 | 4696 | 1035 | C11orf49 | N |
| 247 | 11 | 47098212 | 47098992 | 780 | 1017 | C11orf49 | N |
| 248 | 11 | 84499641 | 84610167 | 110526 | 1026 | DLG2 | Y |
| 249 | 11 | 84972646 | 84980750 | 8104 | 1003 | DLG2 | N |
| 250 | 11 | 88258151 | 88268464 | 10313 | 949 | GRM5 | N |
| 251 | 11 | 88303735 | 88305485 | 1750 | 1003 | GRM5 | N |
| 252 | 12 | 5411179 | 5414622 | 3443 | 1019; 1026 | NTF3 | Y |
| 253 | 12 | 5414623 | 5417862 | 3239 | 1019 | NTF3 | N |
| 254 | 12 | 6315047 | 6317276 | 2229 | 1003; 1005 | TNFRSF1A | N |
| 255 | 12 | 10493985 | 10534393 | 40408 | 947; 979 | KLRC1 | Y |
| 256 | 12 | 15557675 | 15559369 | 1694 | 990; 991; 1011 | PTPRO | N |
| 257 | 12 | 15559370 | 15560873 | 1503 | 990; 1011 | PTPRO | Y |
| 258 | 12 | 31098259 | 31132715 | 34456 | 966; 977; 992; 1011; 1031 | DDX11-AS1, DDX11 | Y |
| 259 | 12 | 31132716 | 31132761 | 45 | 966; 975; 977; 990; 992; 1004; 1011; 1031 | DDX11 | N |
| 260 | 12 | 38904346 | 38909561 | 5215 | 972 | LRRK2 | Y |
| 261 | 12 | 42159304 | 42167699 | 8395 | 946; 951 | ADAMTS20 | N |
| 262 | 12 | 42909733 | 42912201 | 2468 | 979 | TMEM117 | N |
| 263 | 12 | 42912202 | 42913523 | 1321 | 1014 | TMEM117 | N |
| 264 | 12 | 55879318 | 55880397 | 1079 | 1030 | LRP1 | Y |
| 265 | 12 | 55880398 | 55902123 | 21725 | 997; 1030 | LRP1, NXPH4 | Y |
| 266 | 12 | 55903149 | 55922237 | 19088 | 961; 967; 984 | NDUFA4L2, SHMT2, NXPH4 | Y |
| 267 | 12 | 63107981 | 63136048 | 28067 | 1027 | XPOT, TBK1 | Y |
| 268 | 12 | 63346598 | 63347718 | 1120 | 978; 987 | RASSF3 | N |
| 269 | 12 | 63347719 | 63349229 | 1510 | 987 | RASSF3 | N |
| 270 | 12 | 77815879 | 77835641 | 19762 | 1002; 1015 | SYT1 | N |

TABLE 2-continued

| Sub region ID # | Chr | Start | Stop | Size (bp) | PD Case ID | GeneNames | Exon overlap |
|---|---|---|---|---|---|---|---|
| 271 | 12 | 85113258 | 85119077 | 5819 | 2261 | MGAT4C | N |
| 271 | 12 | 85113258 | 85119077 | 5819 | 2338 | MGAT4C | N |
| 271 | 12 | 85113258 | 85119077 | 5819 | 2425 | MGAT4C | N |
| 272 | 12 | 85411806 | 85413202 | 1396 | 1027 | MGAT4C | N |
| 273 | 12 | 85681656 | 85687967 | 6311 | 948; 971; 989 | MGAT4C | N |
| 274 | 12 | 85719690 | 85724956 | 5266 | 979 | MGAT4C | N |
| 275 | 12 | 105966884 | 105967651 | 767 | 950; 964 | CRY1 | N |
| 276 | 12 | 122838898 | 122840411 | 1513 | 975 | DNAH10 | Y |
| 277 | 12 | 130944468 | 130946248 | 1780 | 995; 998; 1005; 1009; 1031; 1033; 1035 | ULK1 | Y |
| 278 | 13 | 24166764 | 24216914 | 50150 | 1002 | ATP12A | Y |
| 279 | 13 | 51954511 | 51973943 | 19432 | 1009; 1014 | TPTE2P3 | Y |
| 280 | 13 | 102137609 | 102139657 | 2048 | 997 | METTL21C | N |
| 281 | 13 | 102139658 | 102142982 | 3324 | 997; 1004 | METTL21C | Y |
| 282 | 13 | 112811735 | 112813401 | 1666 | 965; 971; 972; 973; 978; 992 | F7 | Y |
| 283 | 13 | 113600542 | 113602677 | 2135 | 1020; 1023 | FAM70B | N |
| 284 | 13 | 113791151 | 113792974 | 1823 | 951; 972; 973; 979; 980; 989; 991 | RASA3 | Y |
| 285 | 13 | 113792975 | 113794669 | 1694 | 979; 989; 991 | RASA3 | Y |
| 286 | 14 | 60544757 | 60551980 | 7223 | 991; 1034 | SLC38A6 | N |
| 287 | 14 | 60551981 | 60553070 | 1089 | 951; 954; 991; 1014; 1019; 1034 | SLC38A6 | Y |
| 288 | 14 | 71779767 | 71780825 | 1058 | 998; 1016; 1019 | RGS6 | N |
| 289 | 14 | 72600732 | 72603806 | 3074 | 1007; 1025 | RBM25 | N |
| 290 | 14 | 78086003 | 78087442 | 1439 | 971 | NRXN3 | N |
| 291 | 14 | 78227579 | 78229427 | 1848 | 1002 | NRXN3 | N |
| 292 | 14 | 79127635 | 79128659 | 1024 | 971; 986 | NRXN3 | N |
| 293 | 14 | 79128660 | 79134722 | 6062 | 971 | NRXN3 | N |
| 294 | 14 | 79174722 | 79176036 | 1314 | 1035 | NRXN3 | N |
| 295 | 14 | 102401445 | 102406605 | 5160 | 997 | TRAF3 | Y |
| 296 | 14 | 102406606 | 102409996 | 3390 | 969; 997 | TRAF3 | Y |
| 297 | 14 | 102409997 | 102414214 | 4217 | 997 | TRAF3 | Y |
| 298 | 14 | 104688404 | 104688435 | 31 | 970; 980; 995; 999; 1013; 1035 | JAG2 | Y |
| 299 | 15 | 59220825 | 59221540 | 715 | 996; 998 | RORA | N |
| 300 | 15 | 59220825 | 59234113 | 13288 | 996 | RORA | N |
| 301 | 15 | 59221541 | 59234113 | 12572 | 996 | RORA | N |
| 302 | 15 | 72197969 | 72283889 | 85920 | 1012 | STRA6, ISLR, ISLR2, L0C283731 | Y |
| 303 | 15 | 87999026 | 88000020 | 994 | 954; 994 | KIF7 | Y |
| 304 | 15 | 99236636 | 99239178 | 2542 | 1014; 1029 | ALDH1A3 | Y |
| 305 | 15 | 99634434 | 99635701 | 1267 | 960; 969; 971; 984; 992; 993; 994; 997; 998; 1000; 1003; 1004; 1017; 1025; 1028; 1029; 1035 | VIMP | Y |
| 306 | 16 | 6627719 | 6632582 | 4863 | 1014 | RBFOX1 | N |
| 307 | 16 | 6810852 | 6833768 | 22916 | 982 | RBFOX1 | N |
| 308 | 16 | 6836617 | 6884976 | 48359 | 982 | RBFOX1 | N |
| 309 | 16 | 6886815 | 6896330 | 9515 | 982 | RBFOX1 | N |
| 310 | 16 | 9962571 | 9965023 | 2452 | 1032 | GRIN2A | N |
| 311 | 16 | 9965024 | 9968344 | 3320 | 1001; 1032 | GRIN2A | N |
| 312 | 16 | 9979934 | 9981275 | 1341 | 1032 | GRIN2A | N |
| 313 | 16 | 31186841 | 31256185 | 69344 | 1020 | ITGAM | Y |
| 314 | 16 | 70561211 | 70562690 | 1479 | 948; 1033 | PKD1L3 | Y |
| 315 | 16 | 71619180 | 71648770 | 29590 | 1011 | ZFHX3 | Y |
| 316 | 16 | 81590448 | 81592665 | 2217 | 994 | CDH13 | N |
| 317 | 16 | 81590448 | 81599011 | 8563 | 994 | CDH13 | N |
| 318 | 16 | 81592666 | 81599011 | 6345 | 993; 994 | CDH13 | N |
| 319 | 16 | 81752862 | 81755529 | 2667 | 1025; 1030 | CDH13 | N |
| 320 | 16 | 84330410 | 84332684 | 2274 | 1034 | C16or174, MIR1910 | Y |
| 321 | 16 | 84332684 | 84335524 | 2840 | 999 | C16or174, MIR1910 | Y |
| 322 | 17 | 6399283 | 6401166 | 1883 | 978; 992; 1013; 1017 | PITPNM3 | Y |
| 323 | 17 | 9267206 | 9269293 | 2087 | 1027 | STX8 | N |
| 324 | 17 | 9269293 | 9272211 | 2918 | 982 | STX8 | N |
| 325 | 17 | 16480516 | 16483386 | 2870 | 975; 991; 1004 | ZNF624 | N |
| 326 | 17 | 16483387 | 16489447 | 6060 | 975 | ZNF624 | N |
| 327 | 17 | 41501967 | 41518221 | 16254 | 1024 | KANSL1 | Y |
| 328 | 17 | 41501967 | 41519701 | 17734 | 1024 | KANSL1 | Y |
| 329 | 17 | 41519702 | 41521543 | 1841 | 1024; 1028 | KANSL1 | N |
| 330 | 17 | 62868652 | 62869965 | 1313 | 1009 | PITPNC1 | N |
| 331 | 17 | 62874349 | 62877923 | 3574 | 1007 | PITPNC1 | N |
| 332 | 18 | 169042 | 184227 | 15185 | 957 | USP14 | Y |
| 333 | 18 | 16833161 | 16851074 | 17913 | 965 | ROCK1 | Y |
| 334 | 18 | 31204187 | 31206272 | 2085 | 947; 953; 958; 959; 973 | ZNF396 | N |
| 335 | 18 | 42831086 | 42836022 | 4936 | 947; 953; 971; 988; 1006 | KATNAL2 | Y |
| 336 | 18 | 48127523 | 48131320 | 3797 | 999 | DCC | N |
| 337 | 18 | 48539033 | 48541815 | 2782 | 1013 | DCC | N |

TABLE 2-continued

| Sub region ID # | Chr | Start | Stop | Size (bp) | PD Case ID | GeneNames | Exon overlap |
|---|---|---|---|---|---|---|---|
| 338 | 18 | 48616189 | 48620934 | 4745 | 2054 | DCC | N |
| 338 | 18 | 48616189 | 48620934 | 4745 | 2265 | DCC | N |
| 338 | 18 | 48616189 | 48620934 | 4745 | 2412 | DCC | N |
| 338 | 18 | 48616189 | 48620934 | 4745 | 2428 | DCC | N |
| 338 | 18 | 48616189 | 48620934 | 4745 | 2615 | DCC | N |
| 339 | 18 | 65911512 | 65915539 | 4027 | 955; 964; 1017 | RTTN | N |
| 340 | 18 | 65915540 | 65916735 | 1195 | 955; 964 | RTTN | N |
| 341 | 18 | 65916736 | 65923901 | 7165 | 955; 964; 1028 | RTTN | N |
| 342 | 18 | 65923902 | 65938721 | 14819 | 1028 | RTTN | Y |
| 343 | 19 | 794979 | 798817 | 3838 | 961; 998 | PRTN3 | Y |
| 344 | 19 | 798818 | 801351 | 2533 | 998 | PRTN3 | Y |
| 345 | 19 | 3355220 | 3356334 | 1114 | 949; 951; 954; 970; 978; 995; 1005; 1022; 1034 | NFIC | N |
| 346 | 19 | 9134840 | 9138935 | 4095 | 994; 1008; 1024 | ZNF317 | Y |
| 347 | 19 | 15640597 | 15664289 | 23692 | 1001 | CYP4F12 | Y |
| 348 | 19 | 15664290 | 15667581 | 3291 | 950; 1001 | CYP4F12 | N |
| 349 | 19 | 15667582 | 15677382 | 9800 | 1001 | CYP4F12 | Y |
| 350 | 19 | 42386895 | 42388238 | 1343 | 986; 1012; 1017; 1026 | ZNF585B | N |
| 351 | 19 | 42537228 | 42537766 | 538 | 990; 991; 1014; 1022 | HKR1 | N |
| 352 | 19 | 42537767 | 42544684 | 6917 | 1014 | HKR1 | N |
| 353 | 19 | 54252049 | 54268744 | 16695 | 992 | KCNA7, NTF4 | Y |
| 354 | 19 | 54388780 | 54397344 | 8564 | 993 | TRPM4 | Y |
| 355 | 19 | 60132603 | 60136910 | 4307 | 1025 | NLRP7 | Y |
| 356 | 19 | 61081628 | 61083208 | 1580 | 962; 963; 964; 1003; 1013; 1037 | NLRP4 | Y |
| 357 | 20 | 2873876 | 2877782 | 3906 | 962 | PTPRA | Y |
| 358 | 20 | 19979618 | 19981548 | 1930 | 2190 | C20orf26, CRNKL1 | Y |
| 358 | 20 | 19979618 | 19981548 | 1930 | 2474 | C20orf26, CRNKL1 | Y |
| 358 | 20 | 19979618 | 19981548 | 1930 | 2489 | C20orf26, CRNKL1 | Y |
| 358 | 20 | 19979618 | 19981548 | 1930 | 2597 | C20orf26, CRNKL1 | Y |
| 359 | 20 | 19981549 | 19982732 | 1183 | 2190 | C20orf26, CRNKL1 | N |
| 359 | 20 | 19981549 | 19982732 | 1183 | 2474 | C20orf26, CRNKL1 | N |
| 359 | 20 | 19981549 | 19982732 | 1183 | 2489 | C20orf26, CRNKL1 | N |
| 360 | 20 | 20043913 | 20061717 | 17804 | 947; 960; 964 | C20orf26 | N |
| 361 | 20 | 20061718 | 20061778 | 60 | 947; 960 | C20orf26 | N |
| 362 | 20 | 51045995 | 51053052 | 7057 | 952 | TSHZ2 | N |
| 363 | 20 | 51053053 | 51054248 | 1195 | 952; 961; 975; 980 | TSHZ2 | N |
| 364 | 20 | 51054249 | 51058635 | 4386 | 952; 980 | TSHZ2 | N |
| 365 | 21 | 38473714 | 38675904 | 202190 | 1015 | ERG, DSCR10, KCNJ15 | Y |
| 366 | 22 | 20904937 | 21037378 | 132441 | 947; 963 | LOC96610, VPREB1 | Y |
| 367 | 22 | 22725306 | 22735036 | 9730 | 955; 959; 960; 964 | GSTTP2 | Y |
| 368 | 22 | 42895171 | 42896487 | 1316 | 992; 993; 1013 | PARVB | Y |
| 369 | 22 | 45468407 | 45474188 | 5781 | 966 | CERK | Y |
| 370 | X | 29367686 | 29369448 | 1762 | 958; 1023 | IL1RAPL1 | N |
| 371 | X | 29595687 | 29597689 | 2002 | 1035 | IL1RAPL1 | Y |
| 372 | X | 39852030 | 39853092 | 1062 | 970; 1016; 1031 | BCOR | N |
| 373 | X | 104510036 | 104512681 | 2645 | 979; 1003; 1023 | IL1RAPL2 | N |
| 374 | X | 150893705 | 150894325 | 620 | 981; 1016 | GABRE | Y |
| 375 | X | 152978747 | 152981151 | 2404 | 979; 999; 1022; 1023 | MECP2 | N |

TABLE 3

| Gene ID # | RefSeq Gene Symbol | CNV Gene Region | NCBI Gene ID | Gene Biology Curation | Gene Annotation |
|---|---|---|---|---|---|
| 1 | ACTG1P4 | exonic | 648740 | No gene information | actin, gamma 1 pseudogene 4 (ACTG1P4) |
| 2 | ACYP2 | both | 98 | Acylphosphatase can hydrolyze the phosphoenzyme intermediate of different membrane pumps, particularly the Ca2+/Mg2+-ATPase from sarcoplasmic reticulum of skeletal muscle | Acylphosphatase can hydrolyze the phosphoenzyme intermediate of different membrane pumps, particularly the Ca2+/Mg2+-ATPase from sarcoplasmic reticulum of skeletal muscle |
| 3 | ADAMTS20 | intronic | 80070 | ADAM metallopeptidase with thrombospondin type 1 motif, 20, not much gene information but PD-specific CNVs also found in ADAMTS3, which has neurological links | ADAM metallopeptidase with thrombospondin type 1 motif, 20, not much gene information but PD-specific CNVs also found in ADAMTS3, which has neurological links |
| 4 | ADAMTS3 | intronic | 9508 | ADAM metallopeptidase with thrombospondin type 1 motif, 3; limited gene information but AD link for ADAMTS4, see PMID 10961658: ADAMTS-4 (a disintegrin and metalloproteinase with thrombospondin motifs) is transcriptionally induced in beta-amyloid treated rat astrocytes; but PD-specific CNVs also found in ADAMTS20 | ADAM metallopeptidase with thrombospondin type 1 motif, 3; limited gene information but AD link for ADAMTS4, see PMID 10961658: ADAMTS-4 (a disintegrin and metalloproteinase with thrombospondin motifs) is transcriptionally induced in beta-amyloid treated rat astrocytes; but PD-specific CNVs also found in ADAMTS20 |
| 5 | ADK | intronic | 132 | adenosine kinase and is drug target; neuro link, see PMID 21427729: Adenosine kinase determines the degree of brain injury after ischemic stroke in mice; epilepsy, PMID 21275977: Adenosine kinase as a target for therapeutic antisense strategies in epilepsy; see also PMIDs 21764782, 21401494, 21315743 (schiz); and PD link for PMID 18404497: Neuroprotection by adenosine in the brain: From A(1) receptor activation to A (2A) receptor blockade AND PMID 17942368: Adenosine as a neuromodulator in neurological diseases | adenosine kinase and is drug target; neuro link, see PMID 21427729: Adenosine kinase determines the degree of brain injury after ischemic stroke in mice; epilepsy, PMID 21275977: Adenosine kinase as a target for therapeutic antisense strategies in epilepsy; see also PMIDs 21764782, 21401494, 21315743 (schiz); and PD link for PMID 18404497: Neuroprotection by adenosine in the brain: From A(1) receptor activation to A (2A) receptor blockade AND PMID 17942368: Adenosine as a neuromodulator in neurological diseases |
| 6 | AHI1 | exonic | 54806 | See also KIF7; some AHI1 mutations cause Joubert syndrome (OMIM 608894, 608629), which can cause several abnormalities/symptoms, including the neurological symptoms hypotonia, ataxia, delayed walking and motor movement; mouse model for potential depression phenotype, see PMID 20956301: Neuronal Abelson helper integration site-1 (Ahi1) deficiency in mice alters TrkB signaling with a depressive phenotype; AHI1 TrkB link, see PMID 21192928: Chronic deprivation of TrkB signaling leads to selective late-onset nigrostriatal dopaminergic degeneration; see also PMID 21562748: The TrkB-Positive Dopaminergic Neurons are Less Sensitive to MPTP Insult in the Substantia Nigra of Adult C57/BL Mice | See also KIF7; some AHI1 mutations cause Joubert syndrome (OMIM 608894, 608629), which can cause several abnormalities/symptoms, including the neurological symptoms hypotonia, ataxia, delayed walking and motor movement, see PMID 20956301: Neuronal Abelson helper integration site-1 (Ahi1) deficiency in mice alters TrkB signaling with a depressive phenotype; AHI1 TrkB link, see PMID 21192928: Chronic deprivation of TrkB signaling leads to selective late-onset nigrostriatal dopaminergic degeneration; see also PMID 21562748: The TrkB-Positive Dopaminergic Neurons are Less Sensitive to MPTP Insult in the Substantia Nigra of Adult C57/BL Mice |
| 7 | AKR1B15 | exonic | 441282 | aldo-keto reductase family 1, member B15; limited gene information (PMID 21276782) but | aldo-keto reductase family 1, member B15; limited gene information (PMID 21276782) but link to AD and PD for another |

TABLE 3-continued

| Gene ID # | RefSeq Gene Symbol | CNV Gene Region | NCBI Gene ID | Gene Biology Curation | Gene Annotation |
|---|---|---|---|---|---|
| | | | | link to AD and PD for another gene family member (PMID 19013440): Role of human aldo-keto-reductase AKR1B10 in the protection against toxic aldehydes | gene family member (PMID 19013440): Role of human aldo-keto-reductase AKR1B10 in the protection against toxic aldehydes |
| 8 | ALDH1A3 | exonic | 220 | PD link, 24 PubMed refs for "alcohol dehyzdrogenase AND parkinson's", e.g., see PMID 19388687: Products of oxidative stress inhibit aldehyde oxidation and reduction pathways in dopamine catabolism yielding elevated levels of a reactive intermediate and PMID 14678778: ALDH1 mRNA: presence in human dopamine neurons and decreases in substantia nigra in Parkinson's disease and in the ventral tegmental area in schizophrenia | PD link, 24 PubMed refs for "alcohol dehydrogenase AND parkinson's", e.g., see PMID 19388687: Products of oxidative stress inhibit aldehyde oxidation and reduction pathways in dopamine catabolism yielding elevated levels of a reactive intermediate and PMID 14678778: ALDH1 mRNA: presence in human dopamine neurons and decreases in substantia nigra in Parkinson's disease and in the ventral tegmental area in schizophrenia |
| 9 | ALLC | intronic | 55821 | Allantoicase participates in the uric acid degradation pathway. Its enzymatic activity, like that of urate oxidase (MIM 191540), was lost during vertebrate evolution. [ | Allantoicase participates in the uric acid degradation pathway. Its enzymatic activity, like that of urate oxidase (MIM 191540), was lost during vertebrate evolution. [ |
| 10 | AMY1A | exonic | 276 | alpha-amylase 1 precursor | Amylases are secreted proteins that hydrolyze 1,4-alpha-glucoside bonds in oligosaccharides and polysaccharides, and thus catalyze the first step in digestion of dietary starch and glycogen. The human genome has a cluster of several amylase genes that are expressed at high levels in either salivary gland or pancreas. This gene encodes an amylase isoenzyme produced by the salivary gland. Alternative splicing results in multiple transcript variants encoding the same protein. [provided by RefSeq, July 2008]. Transcript Variant: This variant (2) differs in the 5' UTR, compared to variant 1. Variants 1 and 2 encode the same protein. Publication Note: This RefSeq record includes a subset of the publications that are available for this gene. Please see the Gene record to access additional publications. ##RefSeq-Attributes-START## Transcript_exon_combination_evidence :: AK292341.1 [ECO: 0000332] ##RefSeq-Attributes-END## |
| 11 | AMY1B | exonic | 277 | alpha-amylase 1 precursor | Amylases are secreted proteins that hydrolyze 1,4-alpha-glucoside bonds in oligosaccharides and polysaccharides, and thus catalyze the first step in digestion of dietary starch and glycogen. The human genome has a cluster of several amylase genes that are expressed at high levels in either salivary gland or pancreas. This gene encodes an amylase isoenzyme produced by the salivary gland. [provided by RefSeq, July 2008]. ##RefSeq-Attributes-START## CDS_exon_combination_evidence :: BC069347.1 [ECO: 0000331] ##RefSeq-Attributes-END## |
| 12 | AMY1C | exonic | 278 | alpha-amylase 1 precursor | Amylases are secreted proteins that hydrolyze 1,4-alpha-glucoside bonds in oligosaccharides and polysaccharides, and thus catalyze the first step in digestion of dietary starch and glycogen. The human genome has a cluster of several amylase genes that are expressed at high levels in either salivary gland or pancreas. This gene encodes an amylase isoenzyme produced by the salivary gland. [provided by RefSeq, July 2008]. ##RefSeq-Attributes-START## Transcript_exon_combination_evidence :: |

TABLE 3-continued

| Gene ID # | RefSeq Gene Symbol | CNV Gene Region | NCBI Gene ID | Gene Biology Curation | Gene Annotation |
|---|---|---|---|---|---|
| 13 | AMY2A | exonic | 279 | pancreatic alpha-amylase precursor | BC132995.1, BC063129.1 [ECO: 0000332] ###RefSeq-Attributes-END## Amylases are secreted proteins that hydrolyze 1,4-alpha-glucoside bonds in oligosaccharides and polysaccharides, and thus catalyze the first step in digestion of dietary starch and glycogen. The human genome has a cluster of several amylase genes that are expressed at high levels in either salivary gland or pancreas. This gene encodes an amylase isoenzyme produced by the pancreas. [provided by RefSeq, July 2008]. Publication Note: This RefSeq record includes a subset of the publications that are available for this gene. Please see the Gene record to access additional publications. ###RefSeq-Attributes-START## Transcript_exon_combination_evidence :: BC007060.1, M28443.1 [ECO: 0000332] ###RefSeq-Attributes-END### |
| 14 | AMY2B | both | 280 | Aceview lists this complex region as a single gene (RNPC3andAMY2B); 1,4-alpha-D-glucan glucanohydrolase 2B | Aceview lists this complex region as a single gene (RNPC3andAMY2B); 1,4-alpha-D-glucan glucanohydrolase 2B |
| 15 | ANKRD16 | exonic | 54522 | ankyrin repeats; ankyrin repeats mediate protein-protein interactions in very diverse families of proteins. The number of ANK repeats in a protein can range from 2 to over 20 | ankyrin repeats; ankyrin repeats mediate protein-protein interactions in very diverse families of proteins. The number of ANK repeats in a protein can range from 2 to over 20 |
| 16 | ANKRD20A2 | exonic | 441430 | ankyrin repeat domain-containing protein 20A2 | ankyrin repeat domain 20 family, member A2 (ANKRD20A2) |
| 17 | ANKRD20A3 | exonic | 441425 | ankyrin repeat domain-containing protein 20A3 | ankyrin repeat domain 20 family, member A3 (ANKRD20A3) |
| 18 | AQP7P3 | exonic | 441432 | No gene information | aquaporin 7 pseudogene 3 (AQP7P3) |
| 19 | ATP12A | exonic | 479 | ATPase, H+/K+ transporting, nongastric, alpha polypeptide; via AceView in oxid. phos. pathway (KEGG_00190), which has several NDUFs including NDUFA4L2, which contains PD-specific CNV; PD-specific CNV in 1 PD patient also impacts an ncRNA (ENST00000402733) and gallus gallus has read through transcript from ATP12A across this region; see also mouse model (Wobbler) demonstrating progesterone protection in spinal cord neurodegeneration (PMID 12650717) | ATPase, H+/K+ transporting, nongastric, alpha polypeptide; via AceView in oxid. phos. pathway (KEGG_00190), which has several NDUFs including NDUFA4L2, which contains PD-specific CNV; PD-specific CNV in 1 PD patient also impacts an ncRNA (ENST00000402733) and gallus gallus has read through transcript from ATP12A across this region; see also mouse model (Wobbler) demonstrating progesterone protection in spinal cord neurodegeneration (PMID 12650717) |
| 20 | ATRNL1 | intronic | 26033 | Neuro link, such as PMID 18064672, abstract Atrn null mutant mice have a pleiotropic phenotype including dark fur, juvenile-onset spongiform neurodegeneration, hypomyelination, tremor, and reduced body weight and adiposity, implicating ATRN in numerous biological processes. | Neuro link, such as PMID 18064672, abstract Atrn null mutant mice have a pleiotropic phenotype including dark fur, juvenile-onset spongiform neurodegeneration, hypomyelination, tremor, and reduced body weight and adiposity, implicating ATRN in numerous biological processes. |
| 21 | B3GALNT2 | exonic | 148789 | No gene information | No gene information |
| 22 | BAIAP2L1 | intronic | 55971 | BAI1-associated protein 2-like 1; related genes have neurological or PD link, BAI1 see PMID 21706404 and for BAIAP3 see PMID 21514331: Regulation of the Bcas1 and Baiap3 transcripts in the subthalamic nucleus in mice recovering from MPTP toxicity | BAI1-associated protein 2-like 1; related genes have neurological or PD link, BAI1 see PMID 21706404 and for BAIAP3 see PMID 21514331: Regulation of the Bcas1 and Baiap3 transcripts in the subthalamic nucleus in mice recovering from MPTP toxicity |

TABLE 3-continued

| Gene ID # | RefSeq Gene Symbol | CNV Gene Region | NCBI Gene ID | Gene Biology Curation | Gene Annotation |
|---|---|---|---|---|---|
| 23 | BCOR | intronic | 54880 | BCL6 corepressor; see OMIM 300485, gene mutations causes oculofaciocardiodental syndrome and may cause microphthalmia-2 | BCL6 corepressor; see OMIM 300485, gene mutations causes oculofaciocardiodental syndrome and may cause microphthalmia-2 |
| 24 | BDH2 | exonic | 56898 | No gene information | No gene information |
| 25 | BICC1 | both | 80114 | bicaudal C homolog 1, polycystic kidney disease protein (PMID 20219263) but AD association link too (PMID 16385451); possible homology to bicaudal D in worm, PMID 21205795: *C. elegans* bicd-1, homolog of the *Drosophila* dynein accessory factor Bicaudal D, regulates the branching of PVD sensory neuron dendrites. | bicaudal C homolog 1, polycystic kidney disease protein (PMID 20219263) but AD association link too (PMID 16385451); possible homology to bicaudal D in worm, PMID 21205795: *C. elegans* bicd-1, homolog of the *Drosophila* dynein accessory factor Bicaudal D, regulates the branching of PVD sensory neuron dendrites. |
| 26 | BLVRA | exonic | 644 | Possible cellular aging link and NIH grant 1K08NS057824-01A1 indicate neuro link: CELL SIGNALING AND CYTOPROTECTIVE ROLES OF BILIVERDIN REDUCTASE; for PD link, see PMID 9239525: Increased plasma bilirubin in Parkinson patients on L-dopa: evidence against the free radical hypothesis?; see also PMID 21099244; for AD link, see PMID 21483094 | Possible cellular aging link and NIH grant 1K08NS057824-01A1 indicate neuro link: CELL SIGNALING AND CYTOPROTECTIVE ROLES OF BILIVERDIN REDUCTASE; for PD link, see PMID 9239525: Increased plasma bilirubin in Parkinson patients on L-dopa: evidence against the free radical hypothesis?; see also PMID 21099244; for AD link, see PMID 21483094 |
| 27 | BOLL | exonic | 66037 | Loss of this gene function results in the absence of sperm in semen (azoospermia). Histological studies demonstrated that the primary defect is at the meiotic G2/M transition. | Loss of this gene function results in the absence of sperm in semen (azoospermia). Histological studies demonstrated that the primary defect is at the meiotic G2/M transition. |
| 28 | BREA2 | exonic | 286076 | breast cancer estrogen-induced apoptosis 2; no gene information | breast cancer estrogen-induced apoptosis 2; no gene information |
| 29 | C11orf49 | intronic | 79096 | Limited gene information | Limited gene information |
| 30 | C16orf74 | exonic | 404550 | No gene information | No gene information |
| 31 | C20orf26 | both | 26074 | No gene information | No gene information |
| 32 | C4orf19 | exonic | 55286 | No gene information | No gene information |
| 33 | CACNA1B | exonic | 774 | Gene encodes a Cav2.2 Ca2+ channel and has link to PD, seem PMID 18094105: D2-like dopamine receptors modulate SKCa channel function in subthalamic nucleus neurons through inhibition of Cav2.2 channels; potential drug target, see PMID 19199960 | Gene encodes a Cav2.2 Ca2+ channel and has link to PD, seem PMID 18094105: D2-like dopamine receptors modulate SKCa channel function in subthalamic nucleus neurons through inhibition of Cav2.2 channels; potential drug target, see PMID 19199960 |
| 34 | CACNA2D1 | intronic | 781 | calcium channel, voltage-dependent, alpha 2/delta subunit 1; see PMID review 20579869: A new look at calcium channel √e¬ ±2√e¬¥ subunits | calcium channel, voltage-dependent, alpha 2/delta subunit 1; see PMID review 20579869: A new look at calcium channel √e¬ ±2√e¬¥ subunits |
| 35 | CALML6 | exonic | 163688 | PMID 15621662; expressed in prostate, thymus, heart, skeleton muscle, bone marrow and ovary | PMID 15621662; expressed in prostate, thymus, heart, skeleton muscle, bone marrow and ovary |
| 36 | CAMKMT | exonic | 79823 | This gene encodes a class I protein methyltransferase that acts in the formation of trimethyllysine in calmodulin. The protein contains a AdoMet-binding motif and may play a role in calcium-dependent signaling. | This gene encodes a class I protein methyltransferase that acts in the formation of trimethyllysine in calmodulin. The protein contains a AdoMet-binding motif and may play a role in calcium-dependent signaling. |
| 37 | CAMTA1 | intronic | 23261 | Regulated by RBFOX1 in mouse (PMID 21623373); PD-specific CNVs also found in RBFOX1 | Regulated by RBFOX1 in mouse (PMID 21623373); PD-specific CNVs also found in RBFOX1 |

TABLE 3-continued

| Gene ID # | RefSeq Gene Symbol | CNV Gene Region | NCBI Gene ID | Gene Biology Curation | Gene Annotation |
|---|---|---|---|---|---|
| 38 | CCDC166 | exonic | 100130274 | coiled-coil domain containing 121-like; no gene information | coiled-coil domain containing 121-like; no gene information |
| 39 | CDH13 | intronic | 1012 | cadherin 13, H-cadherin, UCSC summary: This protein acts as a negative regulator of axon growth during neural differentiation. | cadherin 13, H-cadherin, UCSC summary: This protein acts as a negative regulator of axon growth during neural differentiation. |
| 40 | CENPE | exonic | 1062 | Centrosome-associated protein E is a kinesin-like motor protein that accumulates in the G2 phase of the cell cycle. Unlike other centrosome-associated proteins, it is not present during interphase and first appears at the centromere region of chromosomes during prometaphase. CENPE is proposed to be one of the motors responsible for mammalian chromosome movement and/or spindle elongation. | Centrosome-associated protein E is a kinesin-like motor protein that accumulates in the G2 phase of the cell cycle. Unlike other centrosome-associated proteins, it is not present during interphase and first appears at the centromere region of chromosomes during prometaphase. CENPE is proposed to be one of the motors responsible for mammalian chromosome movement and/or spindle elongation. |
| 41 | CERK | exonic | 64781 | Hypothesis for role in PD, see PMID 19021754: Emerging pathways in genetic Parkinson's disease: Potential role of ceramide metabolism in Lewy body disease; CERK converts ceramide to ceramide 1-phosphate (C1P) and is a drug target; see also PMID 2111813 review on CERK and C1P biology: Ceramide kinase: the first decade; CERK link to PD analogous to link between PD and Gaucher√¢‚Ç¨‚Ñ¢s disease, which is caused by GBA mutations. GBA's protein product is glucocerebrosidase, which catalyses the breakdown of the glycolipidglucosylceramide to ceramide and glucose. CERK's protein product catalyzes the next step in this metabolic pathway, converting ceramide to C1P. Multiple USPTO applications for CERK as a drug target, such as 20090081692 and 20090170914; link to JNK pathway, see PMID 19778898: JNK and ceramide kinase govern the biogenesis of lipid droplets through activation of group IVA phospholipase A2 | Hypothesis for role in PD, see PMID 19021754: Emerging pathways in genetic Parkinson's disease: Potential role of ceramide metabolism in Lewy body disease; CERK converts ceramide to ceramide 1-phosphate (C1P) and is a drug target; see also PMID 2111813 review on CERK and C1P biology: Ceramide kinase: the first decade; CERK link to PD analogous to link between PD and Gaucher√¢‚Ç¨‚Ñ¢s disease, which is caused by GBA mutations. GBA's protein product is glucocerebrosidase, which catalyses the breakdown of the glycolipidglucosylceramide to ceramide and glucose. CERK's protein product catalyzes the next step in this metabolic pathway, converting ceramide to C1P. Multiple USPTO applications for CERK as a drug target, such as 20090081692 and 20090170914; link to JNK pathway, see PMID 19778898: JNK and ceramide kinase govern the biogenesis of lipid droplets through activation of group IVA phospholipase A2 |
| 42 | CFH | exonic | 3075 | PMID 15920296, Complement protein isoforms in CSF as possible biomarkers for neurodegenerative disease; PMID 16516157, Complement C3c and related protein biomarkers in amyotrophic lateral sclerosis and Parkinson's disease; see also US patent application 20090275046, Complement factor H protein as a biomarker of Parkinson's disease; PMID 21435440, Complement 3 and factor h in human cerebrospinal fluid in Parkinson's disease, Alzheimer's disease, and multiple-system atrophy. 07Sep: PMID 15920296, Complement protein isoforms in CSF as possible biomarkers for neurodegenerative disease; PMID 16516157, Complement C3c and related protein biomarkers in amyotrophic lateral sclerosis and Parkinson's | PMID 15920296, Complement protein isoforms in CSF as possible biomarkers for neurodegenerative disease; PMID 16516157, Complement C3c and related protein biomarkers in amyotrophic lateral sclerosis and Parkinson's disease; see also US patent application 20090275046, Complement factor H protein as a biomarker of Parkinson's disease; PMID 21435440, Complement 3 and factor h in human cerebrospinal fluid in Parkinson's disease, Alzheimer's disease, and multiple-system atrophy. 07Sep: PMID 16516157, Complement C3c and related protein biomarkers in amyotrophic lateral sclerosis and Parkinson's disease (see also their patent appl United States Patent Application 20090275046, Complement factor H protein as a biomarker of Parkinson's disease); PMID 21435440, Complement 3 and factor h in human cerebrospinal fluid in Parkinson's disease, Alzheimer's disease, and multiple- |

TABLE 3-continued

| Gene ID # | RefSeq Gene Symbol | CNV Gene Region | NCBI Gene ID | Gene Biology Curation | Gene Annotation |
|---|---|---|---|---|---|
| | | | | disease (see also their patent appl United States Patent Application 20090275046, Complement factor H protein as a biomarker of Parkinson's disease); PMID 21435440, Complement 3 and factor h in human cerebrospinal fluid in Parkinson's disease, Alzheimer's disease, and multiple-system atrophy; CNVs in this region also associated with atypical hemolytic uremic syndrome (PMID 19861685) | system atrophy; CNVs in this region also associated with atypical hemolytic uremic syndrome (PMID 19861685) This gene encodes a secreted protein belonging to the complement factor H protein family. It binds to Pseudomonas aeruginosa elongation factor Tuf together with plasminogen, which is proteolytically activated. It is proposed that Tuf acts as a virulence factor by acquiring host proteins to the pathogen surface, controlling complement, and facilitating tissue invasion. Mutations in this gene are associated with an increased risk of atypical hemolytic-uremic syndrome. [provided by RefSeq, Oct 2009]. Publication Note: This RefSeq record includes a subset of the publications that are available for this gene. Please see the Gene record to access additional publications. ##RefSeq-Attributes-START## Transcript_exon_combination_evidence :: BC107771.1, M65292.1 [ECO: 0000332] ##RefSeq-Attributes-END## |
| 43 | CFHR1 | exonic | 3078 | complement factor H-related protein 1 precursor | This gene encodes a secreted protein belonging to the complement factor H protein family. It binds to Pseudomonas aeruginosa elongation factor Tuf together with plasminogen, which is proteolytically activated. It is proposed that Tuf acts as a virulence factor by acquiring host proteins to the pathogen surface, controlling complement, and facilitating tissue invasion. Mutations in this gene are associated with an increased risk of atypical hemolytic-uremic syndrome. [provided by RefSeq, Oct 2009]. Publication Note: This RefSeq record includes a subset of the publications that are available for this gene. Please see the Gene record to access additional publications. ##RefSeq-Attributes-START## Transcript_exon_combination_evidence :: BC107771.1, M65292.1 [ECO: 0000332] ##RefSeq-Attributes-END## |
| 44 | CFHR3 | exonic | 10878 | complement factor H-related protein 3 isoform 2 precursor | The protein encoded by this gene is a secreted protein, which belongs to the complement factor H-related protein family. It binds to heparin, and may be involved in complement regulation. Mutations in this gene are associated with decreased risk of age-related macular degeneration, and with an increased risk of atypical hemolytic-uremic syndrome. Alternatively spliced transcript variants encoding different isoforms have been found for this gene. [provided by RefSeq, October 2011]. Transcript Variant: This variant (2) is missing an in-frame coding exon compared to variant 1, resulting in a shorter isoform (2) lacking an internal protein segment compared to isoform 1. Publication Note: This RefSeq record includes a subset of the publications that are available for this gene. Please see the Gene record to access additional publications. ##RefSeq-Attributes-START## Transcript_exon_combination_evidence :: AK298459.1 [ECO: 0000332] ##RefSeq-Attributes-END## |
| 45 | CFHR4 | exonic | 10877 | complement factor H-related protein 4 isoform 2 precursor | This gene is a member of the complement factor H (CFH) gene family, and encodes one of the 5 CFH-related (CFHR) proteins. These 5 genes are closely linked to the CFH gene on chromosome 1q31-q32. The CFHRs are secreted plasma proteins synthesized primarily by the hepatocytes, and composed of highly-related |

TABLE 3-continued

| Gene ID # | RefSeq Gene Symbol | CNV Gene Region | NCBI Gene ID | Gene Biology Curation | Gene Annotation |
|---|---|---|---|---|---|
| | | | | short consensus repeats (SCRs). This protein enhances the cofactor activity of CFH, and is involved in complement regulation. It can associate with lipoproteins and may play a role in lipid metabolism. Alternatively spliced transcript variants encoding different isoforms (varying in the number of SCRs) have been described for this gene. [provided by RefSeq, January 2011]. Transcript Variant: This variant (1) represents the longest transcript and encodes the longest isoform (1, also known as FHR-4A). Publication Note: This RefSeq record includes a subset of the publications that are available for this gene. Please see the Gene record to access additional publications. ##RefSeq-Attributes-START## Transcript_exon_combination_evidence :: AJ640130.2 [ECO: 0000332] ##RefSeq-Attributes-END## | |
| 46 | CISD2 | exonic | 493856 | The protein encoded by this gene is a zinc finger protein that localizes to the endoplasmic reticulum. The encoded protein binds an iron/sulfur cluster and may be involved in calcium homeostasis. Defects in this gene are a cause of Wolfram syndrome 2. | The protein encoded by this gene is a zinc finger protein that localizes to the endoplasmic reticulum. The encoded protein binds an iron/sulfur cluster and may be involved in calcium homeostasis. Defects in this gene are a cause of Wolfram syndrome 2. |
| 47 | CNBD1 | intronic | 168975 | cyclic nucleotide binding domain containing 1; limited gene information | cyclic nucleotide binding domain containing 1; limited gene information |
| 48 | CNST | exonic | 163882 | PD link, CNST is a binding partner of connexins, which are associated with neuropathies and linked to PD (SNCA binds to connexin-32, connexin-43); several connexin biology refs (PMIDs 19864490, 15852376, 16720574, 17337120, 19232380, 20824494) | PD link, CNST is a binding partner of connexins, which are associated with neuropathies and linked to PD (SNCA binds to connexin-32, connexin-43); several connexin biology refs (PMIDs 19864490, 15852376, 16720574, 17337120, 19232380, 20824494) |
| 49 | CNTNAP2 | intronic | 26047 | neuropsychiatric link, see PMID 21827697: Expanding the clinical spectrum associated with defects in CNTNAP2 and NRXN1; cortical dysplasia-focal epilepsy syndrome (OMIM 610042), symptoms include "During infancy, all patients had mild gross motor delay and subtle limitations in motor skills." | neuropsychiatric link, see PMID 21827697: Expanding the clinical spectrum associated with defects in CNTNAP2 and NRXN1; cortical dysplasia-focal epilepsy syndrome (OMIM 610042), symptoms include "During infancy, all patients had mild gross motor delay and subtle limitations in motor skills." |
| 50 | CNTNAP3 | exonic | 79937 | Gene alias CASPR3 (PMID 12093160); RefSeq summary: The protein encoded by this gene belongs to the NCP family of cell-recognition molecules. This family represents a distinct subgroup of the neurexins. NCP proteins mediate neuron-glial interactions in vertebrates and glial-glial contact in invertebrates. The protein encoded by this gene may play a role in cell recognition within the nervous system. | Gene alias CASPR3 (PMID 12093160); RefSeq summary: The protein encoded by this gene belongs to the NCP family of cell-recognition molecules. This family represents a distinct subgroup of the neurexins. NCP proteins mediate neuron-glial interactions in vertebrates and glial-glial contact in invertebrates. The protein encoded by this gene may play a role in cell recognition within the nervous system. |
| 51 | CNTNAP3B | exonic | 728577 | contactin-associated protein-like 3B precursor | contactin associated protein-like 3B (CNTNAP3B) |
| 52 | COL24A1 | exonic | 255631 | Limited gene information | Limited gene information |
| 53 | CORIN | exonic | 10699 | The encoded protein converts pro-atrial natriuretic peptide to biologically active atrial natriuretic peptide, a cardiac hormone that regulates blood volume and pressure. This protein may also function as a pro-brain-type natriuretic peptide convertase; PMID 21606375: | The encoded protein converts pro-atrial natriuretic peptide to biologically active atrial natriuretic peptide, a cardiac hormone that regulates blood volume and pressure. This protein may also function as a pro-brain-type natriuretic peptide convertase; PMID 21606375: ES cell-derived renewable and functional midbrain dopaminergic progenitors, from abstract "Here, we show that such |

TABLE 3-continued

| Gene ID # | RefSeq Gene Symbol | CNV Gene Region | NCBI Gene ID | Gene Biology Curation | Gene Annotation |
|---|---|---|---|---|---|
| 54 | CRB1 | intronic | 23418 | ES cell-derived renewable and functional midbrain dopaminergic progenitors, from abstract "Here, we show that such authentic mDA NPs can be efficiently isolated from differentiated ES cells (ESCs) using a FACS method combining two markers, Otx2 and Corin"; CORIN gene cited in US patent application 20070128168 | authentic mDA NPs can be efficiently isolated from differentiated ES cells (ESCs) using a FACS method combining two markers, Otx2 and Corin"; CORIN gene cited in US patent application 20070128168 |
| 55 | CREBRF | exonic | 153222 | Leber congenital amaurosis, retinal dystropy, see OMIM 600105 | Leber congenital amaurosis, retinal dystrophy, see OMIM 600105 |
| 56 | CRNKL1 | both | 51340 | crooked neck-like protein 1 | No gene information |
| 57 | CRY1 | intronic | 1407 | circadian rhythm (OMIM 601933) | The crooked neck (crn) gene of *Drosophila* is essential for embryogenesis and is thought to be involved in cell cycle progression and pre-mRNA splicing. This gene is similar in sequence to crn and encodes a protein which can localize to pre-mRNA splicing complexes in the nucleus. The encoded protein, which contains many tetratricopeptide repeats, is required for pre-mRNA splicing. [provided by RefSeq, Jul 2008]. ##RefSeq-Attributes-START## Transcript exon_combination_evidence :: AF318303.1 [ECO: 0000332] ##RefSeq-Attributes-END## circadian rhythm (OMIM 601933) |
| 58 | CTSE | exonic | 1510 | Protein product is a neuroprotease, this class of enzymes is potential drug target for AD, PD, and Huntington (PMID 16626168): Neuroproteases in peptide neurotransmission and neurodegenerative diseases: applications to drug discovery research. | Protein product is a neuroprotease, this class of enzymes is potential drug target for AD, PD, and Huntington (PMID 16626168): Neuroproteases in peptide neurotransmission and neurodegenerative diseases: applications to drug discovery research. |
| 59 | CTSL2 | exonic | 1515 | Gene aliases cathepsin V, CTSV; cathepsin L2; alternate transcript has read through to longer transcript; PMID 21134415: Parkinson's disease involves autophagy and abnormal distribution of cathepsin L; DJ-1 funtions as a cysteine protease according to PMID 20304780: Parkinson disease protein DJ-1 converts from a zymogen to a protease by carboxyl-terminal cleavag; general review, see PMID 16626168: Neuroproteases in peptide neurotransmission and neurodegenerative diseases: applications to drug discovery research | Gene aliases cathepsin V, CTSV; cathepsin L2; alternate transcript has read through to longer transcript; PMID 21134415: Parkinson's disease involves autophagy and abnormal distribution of cathepsin L; DJ-1 funtions as a cysteine protease according to PMID 20304780: Parkinson disease protein DJ-1 converts from a zymogen to a protease by carboxyl-terminal cleavag; general review, see PMID 16626168: Neuroproteases in peptide neurotransmission and neurodegenerative diseases: applications to drug discovery research |
| 60 | CUX1 | intronic | 1523 | Neurological link, see PMID 21331220: Intrinsic programs regulating dendrites and synapses in the upper layer neurons of the cortex. | Neurological link, see PMID 21331220: Intrinsic programs regulating dendrites and synapses in the upper layer neurons of the cortex. |
| 61 | CYP4F12 | both | 66002 | cytochrome P450, family 4, subfamily F, polypeptide 12; not much gene information | cytochrome P450, family 4, subfamily F, polypeptide 12; not much gene information |
| 62 | DCC | intronic | 1630 | Gene encodes a netrin 1 receptor. The transmembrane protein is a member of the immunoglobulin superfamily of cell adhesion molecules, and mediates axon guidance of neuronal growth cones towards sources of netrin 1 ligand. Some DCC mutations cause congenital | Gene encodes a netrin 1 receptor. The transmembrane protein is a member of the immunoglobulin superfamily of cell adhesion molecules, and mediates axon guidance of neuronal growth cones towards sources of netrin 1 ligand. Some DCC mutations cause congenital mirror movements (PMID 21242494); neurological role (OMIM 120470); role in dopamine circuitry (PMID |

TABLE 3-continued

| Gene ID # | RefSeq Gene Symbol | CNV Gene Region | NCBI Gene ID | Gene Biology Curation | Gene Annotation |
|---|---|---|---|---|---|
| 63 | DCTN4 | both | 51164 | mirror movements (PMID 21242494); neurological role (OMIM 120470); role in dopamine circuitry (PMID 21653843): The netrin receptor DCC is required in the pubertal organization of mesocortical dopamine circuitry dynactin and has copper-dependent binding interactions; neurological link (PMID 20807776) and dynactins (e.g., DCTN1) linked to Perry syndrome and ALS (PMIDs 16533145, 18220762, 19506225, 20702129, 21420428); also PD link (PMID 17846173); see also http://www.investorvillage.com/smbd.asp?mb=160&mn=422622&pt=msg&mid=9261691 | 21653843): The netrin receptor DCC is required in the pubertal organization of mesocortical dopamine circuitry dynactin and has copper-dependent binding interactions; neurological link (PMID 20807776) and dynactins (e.g., DCTN1) linked to Perry syndrome and ALS (PMIDs 16533145, 18220762, 19506225, 20702129, 21420428); also PD link (PMID 17846173); see also http://www.investorvillage.com/smbd.asp?mb=160&mn=422622&pt=msg&mid=9261691 |
| 64 | DDX11 | both | 1663 | Causes Warsaw breakage syndrome (OMIM 613398) and associated with telomere length (PMID 15520935) | Causes Warsaw breakage syndrome (OMIM 613398) and associated with telomere length (PMID 15520935) |
| 65 | DDX11-AS1 | exonic | 100506660 | No gene information | No gene information |
| 66 | DGKB | both | 1607 | Many neurological links such as see PMID 18418688, Slowly progressive spinocerebellar ataxia with extrapyramidal signs and mild cognitive impairment (SCA21).; Abstract: Direct sequencing of NDUFA4, PHF14, KIAA0960, ARLA4, ETV1, DGKB, HDAC9, FERD3L, ITGB8, and SP4 genes were performed, but all the direct mutation analyses were negative excluding pathogenic mutations associated with the disease. Therefore, the gene responsible for SCA21 remains to be identified. | Many neurological links such as see PMID 18418688, Slowly progressive spinocerebellar ataxia with extrapyramidal signs and mild cognitive impairment (SCA21).; Abstract: Direct sequencing of NDUFA4, PHF14, KIAA0960, ARLA4, ETV1, DGKB, HDAC9, FERD3L, ITGB8, and SP4 genes were performed, but all the direct mutation analyses were negative excluding pathogenic mutations associated with the disease. Therefore, the gene responsible for SCA21 remains to be identified. |
| 67 | DLG2 | both | 1740 | Gene alias is PSD-93; linked to schizophrenia, bipolar disorder, epilepsy; neuro links. PMID 20097270: Postsynaptic density-93 deficiency protects cultured cortical neurons from N-methyl-D-aspartate receptor-triggered neurotoxicity; PMID 20398908: Comprehensive copy number variant (CNV) analysis of neuronal pathways genes in psychiatric disorders identifies rare variants within patients; PMID 9786987: Localization of postsynaptic density-93 to dendritic microtubules and interaction with microtubule-associated protein 1A; PMID 10725395: The neuregulin receptor ErbB-4 interacts with PDZ-containing proteins at neuronal synapses; PMID 12070168: Selective binding of synapse-associated protein 97 to GluR-A alpha-amino-5-hydroxy-3-methyl-4-isoxazole propionate receptor subunit is determined by a novel sequence motif; PMID 15304517 characterizes longer transcript; see also KCNJ15 for link to INADL, which is linked to DLG2 | Gene alias is PSD-93; linked to schizophrenia, bipolar disorder, epilepsy; neuro links PMID 20097270: Postsynaptic density-93 deficiency protects cultured cortical neurons from N-methyl-D-aspartate receptor-triggered neurotoxicity; PMID 20398908: Comprehensive copy number variant (CNV) analysis of neuronal pathways genes in psychiatric disorders identifies rare variants within patients; PMID 9786987: Localization of postsynaptic density-93 to dendritic microtubules and interaction with microtubule-associated protein 1A; PMID 10725395: The neuregulin receptor ErbB-4 interacts with PDZ-containing proteins at neuronal synapses; PMID 12070168: Selective binding of synapse-associated protein 97 to GluR-A alpha-amino-5-hydroxy-3-methyl-4-isoxazole propionate receptor subunit is determined by a novel sequence motif; PMID 15304517 characterizes longer transcript; see also KCNJ15 for link to INADL, which is linked to DLG2 |

TABLE 3-continued

| Gene ID # | RefSeq Gene Symbol | CNV Gene Region | NCBI Gene ID | Gene Biology Curation | Gene Annotation |
|---|---|---|---|---|---|
| 68 | DLG5 | exonic | 9231 | Neurological link; PMID 20436275: Discs large 5 is required for polarization of citron kinase in mitotic neural precursors; PMID 20505324: Discs large 5: a new regulator of Citron kinase localization in developing neocortex | Neurological link; PMID 20436275: Discs large 5 is required for polarization of citron kinase in mitotic neural precursors; PMID 20505324: Discs large 5: a new regulator of Citron kinase localization in developing neocortex |
| 69 | DLGAP2 | intronic | 9228 | Gene aliases are DAP2 and SAPAP2; AceView indicates interaction with DLG2, which has PD-specific CNV; many neurological references, such as PMID 9694864: A novel multiple PDZ domain-containing molecule interacting with N-methyl-D-aspartate receptors and neuronal cell adhesion proteins | Gene aliases are DAP2 and SAPAP2; AceView indicates interaction with DLG2, which has PD-specific CNV; many neurological references, such as PMID 9694864: A novel multiple PDZ domain-containing molecule interacting with N-methyl-D-aspartate receptors and neuronal cell adhesion proteins |
| 70 | DNAH10 | exonic | 196385 | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy |
| 71 | DNAH12 | exonic | 201625 | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy |
| 72 | DNAH8 | exonic | 1769 | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy | PubMed search "dynein AND parkinson's" yields 13 refs, such as PMID 19295143: Dynamic changes in presynaptic and axonal transport proteins combined with striatal neuroinflammation precede dopaminergic neuronal loss in a rat model of AAV alpha-synucleinopathy |
| 73 | DNAJC18 | exonic | 202052 | Gene alias is HSP40; protein aggregation, PMID 17984091; 20 citations for PubMed search "hsp40 AND parkinson's"; such as PMID 18711724: DnaJB6 is present in the core of Lewy bodies and is highly up-regulated in parkinsonian astrocytes | Gene alias is HSP40; protein aggregation, PMID 17984091; 20 citations for PubMed search "hsp40 AND parkinson's"; such as PMID 18711724: DnaJB6 is present in the core of Lewy bodies and is highly up-regulated in parkinsonian astrocytes |
| 74 | DPP6 | intronic | 1804 | Neurological link, ALS candidate; see PMIDs 19676137, 20001489, 20573902, 20685689; also family member DPP10 CNVs appear in multiple PD cases | Neurological link, ALS candidate; see PMIDs 19676137, 20001489, 20573902, 20685689; also family member DPP10 CNVs appear in multiple PD cases |
| 75 | DSCR10 | exonic | 259234 | No gene information | No gene information |
| 76 | DSCR4 | exonic | 10281 | The region of chromosome 21 between genes CBR and ERG (CBR-ERG region), which spans 2.5 Mb on 21q22.2, has been defined by analysis of patients with partial trisomy 21. It contributes significantly to the pathogenesis of many characteristics of Down syndrome, including morphological features, hypotonia, and mental | The region of chromosome 21 between genes CBR and ERG (CBR-ERG region), which spans 2.5 Mb on 21q22.2, has been defined by analysis of patients with partial trisomy 21. It contributes significantly to the pathogenesis of many characteristics of Down syndrome, including morphological features, hypotonia, and mental retardation. This gene is found in this region and multiple transcripts may exist. It is mainly |

TABLE 3-continued

| Gene ID # | RefSeq Gene Symbol | CNV Gene Region | NCBI Gene ID | Gene Biology Curation | Gene Annotation |
|---|---|---|---|---|---|
| 77 | DSCR8 | exonic | 84677 | retardation. This gene is found in this region and multiple transcripts may exist. It is mainly expressed in the placenta. | expressed in the placenta. |
| 78 | EFNA5 | intronic | 1946 | No gene information RefSeq gene summary: "Ephrin-A5, a member of the ephrin gene family, prevents axon bundling in cocultures of cortical neurons with astrocytes, a model of late stage nervous system development and differentiation"; see also EPHA3, which has neurological and PD links | No gene information RefSeq gene summary: "Ephrin-A5, a member of the ephrin gene family, prevents axon bundling in cocultures of cortical neurons with astrocytes, a model of late stage nervous system development and differentiation"; see also EPHA3, which has neurological and PD links |
| 79 | EPHA3 | exonic | 2042 | OMIM 179611; PMID 18403711: Segregation of axial motor and sensory pathways via heterotypic trans-axonal signaling; PMID 21791286: Anatomical Coupling of Sensory and Motor Nerve Trajectory via Axon Tracking; LRRK2 link, PMID 20096956: Transcriptional profile of Parkinson blood mononuclear cells with LRRK2 mutation | OMIM 179611; PMID 18403711: Segregation of axial motor and sensory pathways via heterotypic trans-axonal signaling; PMID 21791286: Anatomical Coupling of Sensory and Motor Nerve Trajectory via Axon Tracking; LRRK2 link, PMID 20096956: Transcriptional profile of Parkinson blood mononuclear cells with LRRK2 mutation |
| 80 | ERC2 | exonic | 26059 | Neurological links, such as PMID 21228161: Calcium channels link the muscle-derived synapse organizer laminin $\sqrt{e}{-}{\leq}2$ to Bassoon and CAST/Erc2 to organize presynaptic active zones; PMID 19874790: ELKS2alpha/CAST deletion selectively increases neurotransmitter release at inhibitory synapses | Neurological links, such as PMID 21228161: Calcium channels link the muscle-derived synapse organizer laminin $\sqrt{e}{-}{\leq}2$ to Bassoon and CAST/Erc2 to organize presynaptic active zones; PMID 19874790: ELKS2alpha/CAST deletion selectively increases neurotransmitter release at inhibitory synapses |
| 81 | ERG | exonic | 2078 | ERG involved in brain development (PMID 1372068); SNCA-ERG interaction detected: http://www.ebi.ac.uk/intact/pages/interactions/interactions.xhtml?query=EBI-2679254 | ERG involved in brain development (PMID 1372068); SNCA-ERG interaction detected: http://www.ebi.ac.uk/intact/pages/interactions/interactions.xhtml?query=EBI-2679254 |
| 82 | F7 | exonic | 2155 | coagulation factor VII; OMIM 613878 | coagulation factor VII; OMIM 613878 |
| 83 | FABP5P3 | exonic | 220832 | No gene information | fatty acid binding protein 5 pseudogene 3 (FABP5P3) |
| 84 | FAM133CP | exonic | 728640 | No gene information | No gene information |
| 85 | FAM193A | exonic | 8603 | No gene information | No gene information |
| 86 | FAM22A | exonic | 728118 | No gene information | No gene information |
| 87 | FAM22D | exonic | 728130 | No gene information | No gene information |
| 88 | FAM27C | exonic | 100132948 | family with sequence similarity 70, member B; no gene info | family with sequence similarity 27, member C (FAM27C) |
| 89 | FAM35A | exonic | 54537 | | No gene information |
| 90 | FAM70B | both | 348013 | | family with sequence similarity 70, member B |
| 91 | FAM74A1 | exonic | 401507 | No gene information | family with sequence similarity 74, member A1 (FAM74A1) |
| 92 | FAM74A3 | exonic | 728495 | No gene information | family with sequence similarity 74, member A3 (FAM74A3) |
| 93 | FAM95B1 | exonic | 100133036 | No gene information | family with sequence similarity 95, member B1 (FAM95B1) |
| 94 | FBXO18 | both | 84893 | From RefSeq summary: "The F-box proteins constitute one of the four subunits of ubiquitin protein ligase complex called SCFs (SKP1-cullin-F-box), which function in phosphorylation-dependent ubiquitination."PubMed search "cullin AND parkinson's" yields 12 refs, such as PMID | From RefSeq summary: "The F-box proteins constitute one of the four subunits of ubiquitin protein ligase complex called SCFs (SKP1-cullin-F-box), which function in phosphorylation-dependent ubiquitination."PubMed search "cullin AND parkinson's" yields 12 refs, such as PMID 20082978: Modeling sporadic Parkinson's disease by silencing the ubiquitin E3 ligase component, SKP1A |

TABLE 3-continued

| Gene ID # | RefSeq Gene Symbol | CNV Gene Region | NCBI Gene ID | Gene Biology Curation | Gene Annotation |
|---|---|---|---|---|---|
| 95 | FBXW11 | both | 23291 | 20082978: Modeling sporadic Parkinson's disease by silencing the ubiquitin E3 ligase component, SKP1A<br>PMID 18575781: Oxidative stress-induced ubiquitination of RCAN1 mediated by SCFbeta-TrCP ubiquitin ligase; USPTO application 11/914,167 (Lindquist, inventor) | PMID 18575781: Oxidative stress-induced ubiquitination of RCAN1 mediated by SCFbeta-TrCP ubiquitin ligase; USPTO application 11/914,167 (Lindquist, inventor) |
| 96 | FGF10 | exonic | 2255 | Precedence for role of FGFs (22 genes in the family) in variety of diseases including PD (PMID 19621416); OMIM 602115; see PMID 18329286: Localization and fate of Fgf10-expressing cells in the adult mouse brain implicate Fgf10 in control of neurogenesis | Precedence for role of FGFs (22 genes in the family) in variety of diseases including PD (PMID 19621416); OMIM 602115; see PMID 18329286: Localization and fate of Fgf10-expressing cells in the adult mouse brain implicate Fgf10 in control of neurogenesis |
| 97 | FGF12 | intronic | 2257 | Limited gene information; fibroblast growth factors linked to PD pathology, such as PMID 19731552: Neurotrophic support of midbrain dopaminergic neurons | Limited gene information; fibroblast growth factors linked to PD pathology, such as PMID 19731552: Neurotrophic support of midbrain dopaminergic neurons |
| 98 | FGL1 | exonic | 2267 | Fibrinogen-like 1 is a member of the fibrinogen family. This protein is homologous to the carboxy terminus of the fibrinogen beta- and gamma-subunits which contains the four conserved cysteines of fibrinogens and fibrinogen related proteins. However, this protein lacks the platelet-binding site, cross-linking region and a thrombin-sensitive site which are necessary for fibrin clot formation. This protein may play a role in the development of hepatocellular carcinomas. Four alternatively spliced transcript variants encoding the same protein exist for this gene. | Fibrinogen-like 1 is a member of the fibrinogen family. This protein is homologous to the carboxy terminus of the fibrinogen beta- and gamma-subunits which contains the four conserved cysteines of fibrinogens and fibrinogen related proteins. However, this protein lacks the platelet-binding site, cross-linking region and a thrombin-sensitive site which are necessary for fibrin clot formation. This protein may play a role in the development of hepatocellular carcinomas. Four alternatively spliced transcript variants encoding the same protein exist for this gene. |
| 99 | FHIT | exonic | 2272 | FHIT is known as a cancer gene but there are neurological links as well (e.g., see PMIDs 21035495 and 21465257); possible cancer-neurological link because purine metabolism of FHIT and analogously MS and lymphoma drug cladribine (http://en.wikipedia.org/wiki/Cladribine); see also PMID 19302482: Protection of midbrain dopaminergic neurons by the end-product of purine metabolism uric acid: potentiation by low-level depolarization | FHIT is known as a cancer gene but there are neurological links as well (e.g., see PMIDs 21035495 and 21465257); possible cancer-neurological link because purine metabolism of FHIT and analogously MS and lymphoma drug cladribine (http://en.wikipedia.org/wiki/Cladribine); see also PMID 19302482: Protection of midbrain dopaminergic neurons by the end-product of purine metabolism uric acid: potentiation by low-level depolarization |
| 100 | FLJ33630 | intronic | 644873 | No gene information | No gene information |
| 101 | FLJ42393 | exonic | 401105 | No gene information | No gene information |
| 102 | FMNL2 | intronic | 114793 | formin-like protein 2; formin-related proteins have been implicated in morphogenesis, cytokinesis, and cell polarity; activated by RAC and it interacts with SRGAP2, which is also found to contain PD-specific CNVs in two or more PD cases, see PMID 21148482: Bi-modal regulation of a formin by srGAP2 | formin-like protein 2; formin-related proteins have been implicated in morphogenesis, cytokinesis, and cell polarity; activated by RAC and it interacts with SRGAP2, which is also found to contain PD-specific CNVs in two or more PD cases, see PMID 21148482: Bi-modal regulation of a formin by srGAP2 |

TABLE 3-continued

| Gene ID # | RefSeq Gene Symbol | CNV Gene Region | NCBI Gene ID | Gene Biology Curation | Gene Annotation |
|---|---|---|---|---|---|
| 103 | FOXD4L2 | exonic | 100036519 | forkhead box D4-like 2 | forkhead box D4-like 2 (FOXD4L2) |
| 104 | FOXD4L4 | exonic | 349334 | forkhead box protein D4-like 4 | forkhead box D4-like 4 (FOXD4L4) |
| 105 | GABRE | exonic | 2564 | PD link (OMIM 300093), gene located in the candidate regions of 2 different neurological diseases, early-onset parkinsonism, or Waisman syndrome (OMIM 311510), and MRX3 (OMIM 309541), a form of X-linked mental retardation; see also PMID 19625540: Inhibitory transmission in locus coeruleus neurons expressing GABAA receptor epsilon subunit has a number of unique properties; PMID 12633144: Neuronal loss is greater in the locus coeruleus than nucleus basalis and substantia nigra in Alzheimer and Parkinson diseases; potential therapeutic target (PMID 17992687); U.S. Pat. No. 5,654,172; 16 PubMed refs for "GABAA receptor AND Parkinson's", eg, PMID 2851679: GABAA receptor but not muscarinic receptor density was decreased in the brain of patients with Parkinson's disease | PD link (OMIM 300093), gene located in the candidate regions of 2 different neurological diseases, early-onset parkinsonism, or Waisman syndrome (OMIM 311510), and MRX3 (OMIM 309541), a form of X-linked mental retardation; see also PMID 19625540: Inhibitory transmission in locus coeruleus neurons expressing GABAA receptor epsilon subunit has a number of unique properties; PMID 12633144: Neuronal loss is greater in the locus coeruleus than nucleus basalis and substantia nigra in Alzheimer and Parkinson diseases; potential therapeutic target (PMID 17992687); U.S. Pat. No. 5,654,172; 16 PubMed refs for "GABAA receptor AND Parkinson's", eg, PMID 2851679: GABAA receptor but not muscarinic receptor density was decreased in the brain of patients with Parkinson's disease |
| 106 | GADL1 | both | 339896 | Limited gene info, neurological link (PMID 7038682); see also neuro link via protein product (PMIDs 2884126, 1708467, 9497435, 12391091) | Limited gene info, neurological link (PMID 7038682); see also neuro link via protein product (PMIDs 2884126, 1708467, 9497435, 12391091) |
| 107 | GALNT13 | intronic | 114805 | Member of the UDP-N-acetyl-alpha-D-galactosamine:polypeptide N-acetylgalactosaminyltransferase (GalNAcT; EC 2.4.1.41) family, which initiate O-linked glycosylation of mucins (see MUC3A, MIM 158371) by the initial transfer of N-acetylgalactosamine (GalNAc) with an alpha-linkage to a serine or threonine residue; limited gene information | Member of the UDP-N-acetyl-alpha-D-galactosamine:polypeptide N-acetylgalactosaminyltransferase (GalNAcT; EC 2.4.1.41) family, which initiate O-linked glycosylation of mucins (see MUC3A, MIM 158371) by the initial transfer of N-acetylgalactosamine (GalNAc) with an alpha-linkage to a serine or threonine residue; limited gene information |
| 108 | GAS6 | exonic | 2621 | GAS6 is a ligand of AXL; neurological link for AXL, PMID 21569627: Loss of the receptor tyrosine kinase Axl leads to enhanced inflammation in the CNS and delayed removal of myelin debris during experimental autoimmune encephalomyelitis; GAS6 characterized as ligand of AXL, PMID 7854420 and AXL is a drug target; GAS6 and AXL also linked to VEGFA (PMID 15507525), oxidative stress (PMID 15958209), AKT signaling (PMID 18346204), osmotic stress (PMID 18673450), AKL mice model has prolonged axonal damage after cuprizone toxicity (PMID 19541935), NGF and neuronal differentiation and survival (PMID 19027714) | GAS6 is a ligand of AXL; neurological link for AXL, PMID 21569627: Loss of the receptor tyrosine kinase Axl leads to enhanced inflammation in the CNS and delayed removal of myelin debris during experimental autoimmune encephalomyelitis; GAS6 characterized as ligand of AXL, PMID 7854420 and AXL is a drug target; GAS6 and AXL also linked to VEGFA (PMID 15507525), oxidative stress (PMID 15958209), AKT signaling (PMID 18346204), osmotic stress (PMID 18673450), AKL mice model has prolonged axonal damage after cuprizone toxicity (PMID 18804096), MS (PMID 19541935), NGF and neuronal differentiation and survival (PMID 19027714) |

| Gene ID # | RefSeq Gene Symbol | CNV Gene Region | NCBI Gene ID | Gene Biology Curation | Gene Annotation |
|---|---|---|---|---|---|
| 109 | GAS6-AS1 | exonic | 650669 | No gene information | GAS6 antisense RNA 1 (GAS6-AS1) |
| 110 | GGTLC2 | exonic | 91227 | gamma-glutamyltransferase light chain 2 isoform 1 | Gamma-glutamyltransferase-1 (GGT1; MIM 612346) is a membrane-bound extracellular enzyme that cleaves gamma-glutamyl peptide bonds in glutathione and other peptides and transfers the gamma-glutamyl moiety to acceptors. Autocatalytic cleavage of the GGT1 precursor polypeptide produces a heavy chain and a light chain that associate with each other to form the functional enzyme. Light chain-only GGTs, such as GGTLC2, contain a region corresponding to the GGT1 light chain, but they lack the membrane-anchoring heavy chain region (Heisterkamp et al. 2008 [PubMed 18357469]). [supplied by OMIM, October 2008]. ##RefSeq-Attributes-START## Transcript_exon_combination_evidence :: BC069534.1, EL736203.1 [ECO: 0000332] ##RefSeq-Attributes-END## |
| 111 | GNB1 | exonic | 2782 | Heterotrimeric guanine nucleotide-binding proteins (G proteins), which integrate signals between receptors and effector proteins, are composed of an alpha, a beta, and a gamma subunit. These subunits are encoded by families of related genes. This gene encodes a beta subunit. Beta subunits are important regulators of alpha subunits, as well as of certain signal transduction receptors and effectors. This gene uses alternative polyadenylation signals. | Heterotrimeric guanine nucleotide-binding proteins (G proteins), which integrate signals between receptors and effector proteins, are composed of an alpha, a beta, and a gamma subunit. These subunits are encoded by families of related genes. This gene encodes a beta subunit. Beta subunits are important regulators of alpha subunits, as well as of certain signal transduction receptors and effectors. This gene uses alternative polyadenylation signals. |
| 112 | GNG12-AS1 | intronic | 100289178 | No gene information | No gene information |
| 113 | GNG4 | exonic | 2786 | See PMIDs 7782277, A direct interaction between G-protein beta gamma subunits and the Raf-1 protein kinase, and 17055733, Activation of tyrosine kinase receptor signaling pathway by rasagiline facilitates neurorescue and restoration of nigrostriatal dopamine neurons in post-MPTP-induced parkinsonism (abstract cites role of RAF1 in Trk pathway) | See PMIDs 7782277, A direct interaction between G-protein beta gamma subunits and the Raf-1 protein kinase, and 17055733, Activation of tyrosine kinase receptor signaling pathway by rasagiline facilitates neurorescue and restoration of nigrostriatal dopamine neurons in post-MPTP-induced parkinsonism (abstract cites role of RAF1 in Trk pathway) |
| 114 | GPR20 | exonic | 2843 | GPR20 involved in cAMP levels (PMID 18347022), which also has link to PD (PMID 21079735); also, GPR20 overexpression decreases cAMP levels, which some PD drugs can boost (PMID 17100591); cAMP is neuroprotective, PMID 1357186: Cyclic AMP, but not basic FGF, increases the in vitro survival of mesencephalic dopaminergic neurons and protects them from MPP(+)-induced degeneration | GPR20 involved in cAMP levels (PMID 18347022), which also has link to PD (PMID 21079735); also, GPR20 overexpression decreases cAMP levels, which some PD drugs can boost (PMID 17100591); cAMP is neuroprotective, PMID 1357186: Cyclic AMP, but not basic FGF, increases the in vitro survival of mesencephalic dopaminergic neurons and protects them from MPP(+)-induced degeneration |
| 115 | GPR98 | intronic | 84059 | Mutations in this gene are associated with Usher syndrome 2 and familial febrile seizures. | Mutations in this gene are associated with Usher syndrome 2 and familial febrile seizures. |
| 116 | GRIN2A | intronic | 2903 | Neurological role (OMIM 138253) and GWAS PD link (PMID 21876681) | Neurological role (OMIM 138253) and GWAS PD link (PMID 21876681) |
| 117 | GRM5 | intronic | 2915 | glutamate receptor, metabotropic 5; many neurological references and direct PD link, PMID 21103359: Alterations in mGluR5 expression and signaling in Lewy body disease | glutamate receptor, metabotropic 5; many neurological references and direct PD link, PMID 21103359: Alterations in mGluR5 expression and signaling in Lewy body disease and in transgenic models of alpha-synucleinopathy--implications for excitotoxicity. |

TABLE 3-continued

| Gene ID # | RefSeq Gene Symbol | CNV Gene Region | NCBI Gene ID | Gene Biology Curation | Gene Annotation |
|---|---|---|---|---|---|
| 118 | GSTTP2 | exonic | 653399 | and in transgenic models of alpha-synucleinopathy--implications for excitotoxicity. glutathione S-transferase theta pseudogene 2; limited gene information | glutathione S-transferase theta pseudogene 2; limited gene information |
| 119 | HDAC9 | exonic | 9734 | Neurological link, see PMIDs 20525065 and 20525066: Nucleocytoplasmic translocation of HDAC9 regulates gene expression and dendritic growth in developing cortical neurons; HDAC role in GAD expression and potential therapeutic of HDAC inhibitor, PMID 17360583: Histone hyperacetylation induces demethylation of reelin and 67-kDa glutamic acid decarboxylase promoters; PMID 20947501: Histone deacetylase 9 (HDAC9) regulates the functions of the ATDC (TRIM29) protein; HDRP (HDAC9 alt gene name) is neuroprotective, PMID 16611996: Neuroprotection by histone deacetylase-related protein; PMID 15711539: Histone deacetylase 9 couples neuronal activity to muscle chromatin acetylation and gene expression; also HDAC9 link to MEF2, PMID 20197093: MEF-2 regulates activity-dependent spine loss in striatopallidal medium spiny neurons, PMID 21393861: Direct regulation of complex I by mitochondrial MEF2D is disrupted in a mouse model of Parkinson disease and in human patients | glutathione S-transferase theta pseudogene 2; limited gene information Neurological link, see PMIDs 20525065 and 20525066: Nucleocytoplasmic translocation of HDAC9 regulates gene expression and dendritic growth in developing cortical neurons; HDAC role in GAD expression and potential therapeutic of HDAC inhibitor, PMID 17360583: Histone hyperacetylation induces demethylation of reelin and 67-kDa glutamic acid decarboxylase promoters; PMID 20947501: Histone deacetylase 9 (HDAC9) regulates the functions of the ATDC (TRIM29) protein; HDRP (HDAC9 alt gene name) is neuroprotective, PMID 16611996: Neuroprotection by histone deacetylase-related protein; PMID 15711539: Histone deacetylase 9 couples neuronal activity to muscle chromatin acetylation and gene expression; also HDAC9 link to MEF2, PMID 20197093: MEF-2 regulates activity-dependent spine loss in striatopallidal medium spiny neurons, PMID 21393861: Direct regulation of complex I by mitochondrial MEF2D is disrupted in a mouse model of Parkinson disease and in human patients |
| 120 | HKR1 | intronic | 284459 | HKR1, GLI-Kruppel zinc finger family member; link to MAPK pathway but most work done in yeast | HKR1, GLI-Kruppel zinc finger family member; link to MAPK pathway but most work done in yeast |
| 121 | HTA | exonic | 283902 | No gene information | No gene information |
| 122 | HTR1E | exonic | 3354 | 5-hydroxytryptamine (serotonin) receptor 1E; PubMed citations include psych disorders and migraine but see also: http://onlinelibrary.wiley.com/doi/10.1002/mds.20370/full; Drug target (http://www.freepatentsonline.com/5786155.html) but hard to find specific compounds and animal model (not expressed in rodents but human homolog found in guinea pig), potential role in memory, pain, mental health and PD as other 5-HT receptors are PD drug targets; Synaptic Pharmaceuticals now part of a Danish company: http://www.lundbeckresearch.us/; see also PMIDs 19200348, 21422162 | 5-hydroxytryptamine (serotonin) receptor 1E; PubMed citations include psych disorders and migraine but see also: http://onlinelibrary.wiley.com/doi/10.1002/mds.20370/full; Drug target (http://www.freepatentsonline.com/5786155.html) but hard to find specific compounds and animal model (not expressed in rodents but human homolog found in guinea pig), potential role in memory, pain, mental health and PD as other 5-HT receptors are PD drug targets; Synaptic Pharmaceuticals now part of a Danish company: http://www.lundbeckresearch.us/; see also PMIDs 19200348, 21422162 |
| 123 | IGLL5 | exonic | 100423062 | immunoglobulin lambda-like polypeptide 5 isoform 2 | This gene encodes one of the immunoglobulin lambda-like polypeptides. It is located within the immunoglobulin lambda locus but it does not require somatic rearrangement for expression. The first exon of this gene is unrelated to immunoglobulin variable genes; the second and third exons are the immunoglobulin |

TABLE 3-continued

| Gene ID # | RefSeq Gene Symbol | CNV Gene Region | NCBI Gene ID | Gene Biology Curation | Gene Annotation |
|---|---|---|---|---|---|
| 124 | IGSF21 | intronic | 84966 | Limited gene information | lambda joining 1 and the immunoglobulin lambda constant 1 gene segments. Alternative splicing results in multiple transcript variants. [provided by RefSeq, May 2010]. Transcript Variant: This variant (1) represents the longer transcript and encodes the longer isoform (1). ##RefSeq-Attributes-START## Transcript_exon_combination_evidence :: AJ318022.1, BG756003.1 [ECO: 0000332] ##RefSeq-Attributes-END## Limited gene information |
| 125 | IKBKB | exonic | 3551 | PD link: PMID 17314283: Parkin mediates neuroprotection through activation of IkappaB kinase/nuclear factor-kappaB signaling; PMID 20190013. Inhibition of IkappaB kinase-beta protects dopamine neurons against lipopolysaccharide-induced neurotoxicity. | PD link: PMID 17314283: Parkin mediates neuroprotection through activation of IkappaB kinase/nuclear factor-kappaB signaling; PMID 20190013. Inhibition of IkappaB kinase-beta protects dopamine neurons against lipopolysaccharide-induced neurotoxicity. |
| 126 | IL1RAPL1 | both | 11141 | interleukin 1 receptor accessory protein-like 1; neurological link, such as PMID 17502602: IL1-receptor accessory protein-like 1 (IL1RAPL1), a protein involved in cognitive functions, regulates N-type Ca2+-channel and neurite elongation; PMID 21926414: The X-linked intellectual disability protein IL1RAPL1 regulates excitatory synapse formation by binding PTP{delta} and RhoGAP2; IL1RAPL2 also contains PD-specific CNVs | interleukin 1 receptor accessory protein-like 1; neurological link, such as PMID 17502602: IL1-receptor accessory protein-like 1 (IL1RAPL1), a protein involved in cognitive functions, regulates N-type Ca2+-channel and neurite elongation; PMID 21926414: The X-linked intellectual disability protein IL1RAPL1 regulates excitatory synapse formation by binding PTP{delta} and RhoGAP2; IL1RAPL2 also contains PD-specific CNVs |
| 127 | IL1RAPL2 | intronic | 26280 | neurological link (PMID 11587848): IL1RAPL2 maps to Xq22 and is specifically expressed in the central nervous system; IL1RAPL1 also contains PD-specific CNVs | neurological link (PMID 11587848): IL1RAPL2 maps to Xq22 and is specifically expressed in the central nervous system; IL1RAPL1 also contains PD-specific CNVs |
| 128 | IQCG | exonic | 84223 | IQ domain-containing protein G; limited gene information but neurological link for other IQ domain proteins, see AceView entry: "Some proteins known to contain an IQ motif are listed below: A number of conventional and unconventional myosins. Neuromodulin (GAP-43). This protein is associated with nerve growth. It is a major component of the motile "growth cones" that form the tips of elongating axons. Neurogranin (NG/p17). Acts as a "third messenger" substrate of protein kinase C-mediated molecular cascades during synaptic development and remodeling. Sperm surface protein Sp17. Ras GTPase-activating-like protein IQGAP1. IQGAP1 contains 4 IQ motifs." | IQ domain-containing protein G; limited gene information but neurological link for other IQ domain proteins, see AceView entry: "Some proteins known to contain an IQ motif are listed below: A number of conventional and unconventional myosins. Neuromodulin (GAP-43). This protein is associated with nerve growth. It is a major component of the motile "growth cones" that form the tips of elongating axons. Neurogranin (NG/p17). Acts as a "third messenger" substrate of protein kinase C-mediated molecular cascades during synaptic development and remodeling. Sperm surface protein Sp17. Ras GTPase-activating-like protein IQGAP1. IQGAP1 contains 4 IQ motifs." |
| 129 | ISLR | exonic | 3671 | No gene information | No gene information |
| 130 | ISLR2 | exonic | 57611 | No gene information | No gene information |
| 131 | ITGAM | exonic | 3684 | Gene alias is MAC-1 and has AD/PD link, PMID 21232086: Microglial MAC1 receptor and PI3K are essential in mediating b-amyloid peptide-induced microglial activation and subsequent neurotoxicity | Gene alias is MAC-1 and has AD/PD link, PMID 21232086: Microglial MAC1 receptor and PI3K are essential in mediating b-amyloid peptide-induced microglial activation and subsequent neurotoxicity |

TABLE 3-continued

| Gene ID # | RefSeq Gene Symbol | CNV Gene Region | NCBI Gene ID | Gene Biology Curation | Gene Annotation |
|---|---|---|---|---|---|
| 132 | JAG2 | exonic | 3714 | Cancer link but also neurological link, such as PMID 20680491: Proliferating neural progenitors in the developing CNS of zebrafish require Jagged2 and Jagged1b. | Cancer link but also neurological link, such as PMID 20680491: Proliferating neural progenitors in the developing CNS of zebrafish require Jagged2 and Jagged1b. |
| 133 | KANSL1 | both | 284058 | Link to MAPT locus, see also PMID 11641718 | Link to MAPT locus, see also PMID 11641718 |
| 134 | KANSL1-AS1 | exonic | 644246 | No gene information | KANSL1 antisense RNA 1 (KANSL1-AS1) |
| 135 | KATNAL2 | exonic | 83473 | katanin p60 subunit A-like 2; no gene information | katanin p60 subunit A-like 2; no gene information |
| 136 | KCNA7 | exonic | 3743 | This gene encodes a member of the potassium channel, voltage-gated, shaker-related subfamily. This member contains six membrane-spanning domains with a shaker-type repeat in the fourth segment. The gene is expressed preferentially in skeletal muscle, heart and kidney. It is a candidate gene for inherited cardiac disorders. | This gene encodes a member of the potassium channel, voltage-gated, shaker-related subfamily. This member contains six membrane-spanning domains with a shaker-type repeat in the fourth segment. The gene is expressed preferentially in skeletal muscle, heart and kidney. It is a candidate gene for inherited cardiac disorders. |
| 137 | KCNJ15 | exonic | 3772 | Gene aliases IRKK; KIR1.3; KIR4.2; neurological link, see PMID 9647694: CIPP [gene alias INADL], a novel multivalent PDZ domain protein, selectively interacts with Kir4.0 family members, NMDA receptor subunits, neurexins, and neuroligins and PMID 15068243: Chromosome 21 KIR channels in brain development; via AceView on INADL, DLG2 listed as a second interactor, which is also found to harbor a PD-specific CNV | Gene aliases IRKK; KIR1.3; KIR4.2; neurological link, see PMID 9647694: CIPP [gene alias INADL], a novel multivalent PDZ domain protein, selectively interacts with Kir4.0 family members, NMDA receptor subunits, neurexins, and neuroligins and PMID 15068243: Chromosome 21 KIR channels in brain development; via AceView on INADL, DLG2 listed as a second interactor, which is also found to harbor a PD-specific CNV |
| 138 | KCNMA1 | exonic | 3778 | Some gene mutations cause paroxysmal dyskinesia (OMIM 600150, see mouse model); KCNMA1 is a BK channel, which are implicated in neurological disorders, see PMID 11060806: Is there a role for potassium channel openers in neuronal ion channel disorders? And PMID 11222629: Oxidative regulation of large conductance calcium-activated potassium channels. | Some gene mutations cause paroxysmal dyskinesia (OMIM 600150, see mouse model); KCNMA1 is a BK channel, which are implicated in neurological disorders, see PMID 11060806: Is there a role for potassium channel openers in neuronal ion channel disorders? And PMID 11222629: Oxidative regulation of large conductance calcium-activated potassium channels. |
| 139 | KCNN3 | exonic | 3782 | Link to ataxia and PD (PMIDs 11594924, 18650029), see also PMID 21767612: Spike frequency adaptation is developmentally regulated in substantia nigra pars compacta dopaminergic neurons | Link to ataxia and PD (PMIDs 11594924, 18650029), see also PMID 21767612: Spike frequency adaptation is developmentally regulated in substantia nigra pars compacta dopaminergic neurons |
| 140 | KGFLP2 | exonic | 654466 | No gene information | keratinocyte growth factor-like protein 2 (KGFLP2) |
| 141 | KIAA1751 | exonic | 85452 | No gene information | No gene information |
| 142 | KIF7 | exonic | 374654 | AD/PD link, see PMID 18725959: The actin-binding protein capulet genetically interacts with the microtubule motor kinesin to maintain neuronal dendrite homeostasis and PMID 18845538: Parkin regulates Eg5 [motor protein of kinesin family] expression by Hsp70 ubiquitination-dependent inactivation of c-Jun NH2-terminal kinase; See also AHI1; OMIM phenotypic series includes a Joubert syndrome | AD/PD link, see PMID 18725959: The actin-binding protein capulet genetically interacts with the microtubule motor kinesin to maintain neuronal dendrite homeostasis and PMID 18845538: Parkin regulates Eg5 [motor protein of kinesin family] expression by Hsp70 ubiquitination-dependent inactivation of c-Jun NH2-terminal kinase; See also AHI1; OMIM phenotypic series includes KIF7 (OMIM 200990); via AceView, link to CENPE and DNAHs |

TABLE 3-continued

| Gene ID # | RefSeq Gene Symbol | CNV Gene Region | NCBI Gene ID | Gene Biology Curation | Gene Annotation |
|---|---|---|---|---|---|
| 143 | KLRC1 | exonic | 3821 | locus (15q26.1) that includes KIF7 (OMIM 200990); via AceView, link to CENPE and DNAHs<br>Gene alias is NKG2A, associated with autoimmune disease (OMIM 161555) | Gene alias is NKG2A, associated with autoimmune disease (OMIM 161555) |
| 144 | KLRC2 | exonic | 3822 | NKG2-C type II integral membrane protein | Natural killer (NK) cells are lymphocytes that can mediate lysis of certain tumor cells and virus-infected cells without previous activation. They can also regulate specific humoral and cell-mediated immunity. NK cells preferentially express several calcium-dependent (C-type) lectins, which have been implicated in the regulation of NK cell function. The group, designated KLRC (NKG2) are expressed primarily in natural killer (NK) cells and encodes a family of transmembrane proteins characterized by a type II membrane orientation (extracellular C terminus) and the presence of a C-type lectin domain. The KLRC (NKG2) gene family is located within the NK complex, a region that contains several C-type lectin genes preferentially expressed on NK cells. KLRC2 alternative splice variants have been described but their full-length nature has not been determined [provided by RefSeq, Jul 2008]. Publication Note: This RefSeq record includes a subset of the publications that are available for this gene. Please see the Gene record to access additional publications. ##RefSeq-Attributes-START## Transcript_exon_combination_evidence :: X54869.1, AF078550.1 [ECO:0000332] ##RefSeq-Attributes-END## |
| 145 | KLRC3 | exonic | 3823 | NKG2-E type II integral membrane protein isoform H | Natural killer (NK) cells are lymphocytes that can mediate lysis of certain tumor cells and virus-infected cells without previous activation. They can also regulate specific humoral and cell-mediated immunity. NK cells preferentially express several calcium-dependent (C-type) lectins, which have been implicated in the regulation of NK cell function. KLRC3 is a member of the NKG2 group which are expressed primarily in natural killer (NK) cells and encodes a family of transmembrane proteins characterized by a type II membrane orientation (extracellular C terminus) and the presence of a C-type lectin domain. The NKG2 gene family is located within the NK complex, a region that contains several C-type lectin genes preferentially expressed on NK cells. Alternative splicing results in multiple transcript variants encoding different isoforms. [provided by RefSeq, Jul 2008]. Transcript Variant: This variant (1), also known as NKG2-E, represents the longer transcript but encodes the shorter isoform (E). |
| 146 | KYNU | exonic | 8942 | PD link and other neuro diseases via kynurenine pathway, see PMID 21687761: The involvement of neuroinflammation and kynurenine pathway in Parkinson's disease | PD link and other neuro diseases via kynurenine pathway, see PMID 21687761: The involvement of neuroinflammation and kynurenine pathway in Parkinson's disease |
| 147 | LGI1 | intronic | 9211 | leucine-rich, glioma inactivated 1; see OMIM 604619, strong neuro function and causes epilepsy, for example see PMIDs 20663977 and 20130004 | leucine-rich, glioma inactivated 1; see OMIM 604619, strong neuro function and causes epilepsy, for example see PMIDs 20663977 and 20130004 |
| 148 | LINC00271 | exonic | 100131814 | No gene information | No gene information |

TABLE 3-continued

| Gene ID # | RefSeq Gene Symbol | CNV Gene Region | NCBI Gene ID | Gene Biology Curation | Gene Annotation |
|---|---|---|---|---|---|
| 149 | LMLN | exonic | 89782 | leishmanolysin-like (metallopeptidase M8 family), gene alias is invadolysin (PMID 15557119) | leishmanolysin-like (metallopeptidase M8 family), gene alias is invadolysin (PMID 15557119) |
| 150 | LOC100128292 | exonic | 100128292 | No gene information | No gene information |
| 151 | LOC100128822 | exonic | 100128822 | No gene information | uncharacterized LOC100128822 (LOC100128822) |
| 152 | LOC100506172 | exonic | 100506172 | No gene information | No gene information |
| 153 | LOC255130 | both | 255130 | No gene information | No gene information |
| 154 | LOC255654 | exonic | 255654 | No gene information | No gene information |
| 155 | LOC283731 | exonic | 283731 | No gene information | No gene information |
| 156 | LOC286297 | exonic | 286297 | No gene information | uncharacterized LOC286297 (LOC286297) |
| 157 | LOC439994 | exonic | 439994 | No gene information | No gene information |
| 158 | LOC642929 | exonic | 642929 | No gene information | general transcription factor II, i pseudogene (LOC642929) |
| 159 | LOC643648 | exonic | 643648 | No gene information | uncharacterized LOC643648 (LOC643648) |
| 160 | LOC648691 | exonic | 648691 | No gene information | uncharacterized LOC648691 (LOC648691) |
| 161 | LOC653501 | exonic | 653501 | No gene information | zinc finger protein 658 pseudogene (LOC653501) |
| 162 | LOC728190 | exonic | 728190 | No gene information | No gene information |
| 163 | LOC728218 | exonic | 728218 | No gene information | No gene information |
| 164 | LOC731779 | exonic | 731779 | No gene information | No gene information |
| 165 | LOC96610 | exonic | 96610 | BMS1 homolog, ribosome assembly protein (yeast) pseudogene; limited gene information (OMIM 605141) | BMS1 homolog, ribosome assembly protein (yeast) pseudogene; limited gene information (OMIM 605141) |
| 166 | LPP | exonic | 4026 | Gene product is a member of zyxin protein family and has a role in cell migration and focal adhesions (PMID 19111675), with potential link to PD/AD via alpha actinin (PMID 3293578) | Gene product is a member of zyxin protein family and has a role in cell migration and focal adhesions (PMID 19111675), with potential link to PD/AD via alpha actinin (PMID 3293578) |
| 167 | LRCH3 | exonic | 84859 | leucine-rich repeats and calponin homology (CH) domain containing 3; no gene function information but AceView indicates itν¿,Ç¨, Ñés a putative partner of YWHAG, which has been shown to interact with RAF1(PD link PMID 17055733) and protein kinase C | leucine-rich repeats and calponin homology (CH) domain containing 3; no gene function information but AceView indicates itν¿,Ç¨, Ñés a putative partner of YWHAG, which has been shown to interact with RAF1(PD link PMID 17055733) and protein kinase C |
| 168 | LRP1 | exonic | 4035 | Gene alias is A2MR; AD link (PMID 21585370) and neurological link (PMID 21779915) | Gene alias is A2MR; AD link (PMID 21585370) and neurological link (PMID 21779915) |
| 169 | LRP2 | exonic | 4036 | PD link and Neurological links; PMID 21800131: Up-regulation of metallothionein gene expression in Parkinsonian astrocytes; some LRP2 mutations cause Donnai-Barrow syndrome which can include brain malformations (OMIM 600073); PMID 21720686: New insights into the roles of megalin/LRP2 and the regulation of its functional expression, abstract states, "expression of megalin and some of its ligands in the central and peripheral nervous system suggests a role for this receptor in neural regeneration processes;" also linked to APP function (PMID 21947084); PMID 21833580: Metallothionein promotes regenerative axonal sprouting of dorsal root ganglion neurons after | PD link and Neurological links; PMID 21800131: Up-regulation of metallothionein gene expression in Parkinsonian astrocytes; some LRP2 mutations cause Donnai-Barrow syndrome which can include brain malformations (OMIM 600073); PMID 21720686: New insights into the roles of megalin/LRP2 and the regulation of its functional expression, abstract states, "expression of megalin and some of its ligands in the central and peripheral nervous system suggests a role for this receptor in neural regeneration processes;" also linked to APP function (PMID 21947084); PMID 21833580: Metallothionein promotes regenerative axonal sprouting of dorsal root ganglion neurons after physical axotomy, abstract states "This study provides a clear indication that MT [metallothionein I/II] promotes axonal regeneration of DRG neurons, via a megalin- and MAPK-dependent mechanism;" see also PMID 21779915 |

TABLE 3-continued

| Gene ID # | RefSeq Gene Symbol | CNV Gene Region | NCBI Gene ID | Gene Biology Curation | Gene Annotation |
|---|---|---|---|---|---|
| 170 | LRRFIP1 | intronic | 9208 | physical axotomy, abstract states "This study provides a clear indication that MT [metallothionein I/II] promotes axonal regeneration of DRG neurons, via a megalin- and MAPK-dependent mechanism;" see also PMID 21779915 Interferon response (PMID 20586614) and linked to lysosomal structures (PMID 21102652), both processes linked to PD | Interferon response (PMID 20586614) and linked to lysomoal structures (PMID 21102652), both processes linked to PD |
| 171 | LRRIQ3 | both | 127255 | No gene information | No gene information |
| 172 | LRRK2 | exonic | 120892 | Some mutations are causative of PD (OMIM 609007) | Some mutations are causative of PD (OMIM 609007) |
| 173 | MAGI3 | intronic | 260425 | PMID 15458844: The complexity of PDZ domain-mediated interactions at glutamatergic synapses: a case study on neuroligin | PMID 15458844: The complexity of PDZ domain-mediated interactions at glutamatergic synapses: a case study on neuroligin |
| 174 | MANBA | exonic | 4126 | OMIM 609489, deletion causes spinocerebellar ataxia disease (PMID 18980795), not sure about gain | OMIM 609489, deletion causes spinocerebellar ataxia disease (PMID 18980795), not sure about gain |
| 175 | MAP2 | intronic | 4133 | 35 PubMed citations for "MAP2 AND parkinson's" | 35 PubMed citations for "MAP2 AND parkinson's" |
| 176 | MAS1 | exonic | 4142 | Gene linked to cancer but also neurobehavioral and blood pressure roles, see OMIM 165180; neurological link, see PMID 21178125: ACE2/ANG-(1-7)/Mas pathway in the brain: the axis of good | Gene linked to cancer but also neurobehavioral and blood pressure roles, see OMIM 165180; neurological link, see PMID 21178125: ACE2/ANG-(1-7)/Mas pathway in the brain: the axis of good |
| 177 | MATN2 | intronic | 4147 | matrilin 2 has strong neurological link, see PMID 19295126: The extracellular-matrix protein matrilin 2 participates in peripheral nerve regeneration | matrilin 2 has strong neurological link, see PMID 19295126: The extracellular-matrix protein matrilin 2 participates in peripheral nerve regeneration |
| 178 | MECP2 | intronic | 4204 | methyl CpG binding protein 2 (Rett syndrome); see OMIM 300005; link to PD, PMID review 19833297 and PMID 21880923: Loss of mecp2 in substantia nigra dopamine neurons compromises the nigrostriatal pathway | methyl CpG binding protein 2 (Rett syndrome); see OMIM 300005; link to PD, PMID review 19833297 and PMID 21880923: Loss of mecp2 in substantia nigra dopamine neurons compromises the nigrostriatal pathway |
| 179 | MEGF10 | both | 84466 | Neurological and AD links, PMID 20828568: MEGF10 functions as a receptor for the uptake of amyloid-√e¬s. | Neurological and AD links, PMID 20828568: MEGF10 functions as a receptor for the uptake of amyloid-√e¬s. |
| 180 | METTL21C | both | 196541 | Gene alias is C13orf39; methyltransferase like 21C, no gene info but present in 2 of 87 PD cases and 0 of 1005 Normals | Gene alias is C13orf39; methyltransferase like 21C, no gene info but present in 2 of 87 PD cases and 0 of 1005 Normals |
| 181 | MGAM | exonic | 8972 | maltase-glucoamylase, starch digestion; glucose metabolism (PMID 19193815) | maltase-glucoamylase, starch digestion; glucose metabolism (PMID 19193815) |
| 182 | MGAT4C | intronic | 25834 | mannosyl (alpha-1,3-)glycoprotein beta-1,4-N-acetylglucosaminyltransferase, isozyme C; limited gene information but mice lacking N-acetylglucosaminyltransferase I die mid-gestation and embryos are developmentally retarded, most noticeably in neural tissue (PMID 8290590) | mannosyl (alpha-1,3-)glycoprotein beta-1,4-N-acetylglucosaminyltransferase, isozyme C; limited gene information but mice lacking N-acetylglucosaminyltransferase I die mid-gestation and embryos are developmentally retarded, most noticeably in neural tissue (PMID 8290590) |
| 183 | MGC21881 | exonic | 389741 | No gene information | uncharacterized locus MGC21881 (MGC21881) |
| 184 | MIR1910 | exonic | 100302261 | No gene information | No gene information |

TABLE 3-continued

| Gene ID # | RefSeq Gene Symbol | CNV Gene Region | NCBI Gene ID | Gene Biology Curation | Gene Annotation |
|---|---|---|---|---|---|
| 185 | MIR3123 | exonic | 100422856 | No gene information | No gene information |
| 186 | MIR548H4 | exonic | 100313884 | No gene information | No gene information |
| 187 | MIR548T | intronic | 100422849 | No gene information | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| 188 | MIR5694 | exonic | 100847064 | No gene information | No gene information |
| 189 | MIR650 | exonic | 723778 | No gene information | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| 190 | MLL3 | both | 58508 | myeloid/lymphoid or mixed-lineage leukemia 3; limited gene information | myeloid/lymphoid or mixed-lineage leukemia 3; limited gene information |
| 191 | MNX1 | exonic | 3110 | Gene alias is HLXB9 and it causes Currarino syndrome (also Currarino triad) is an inherited congenital disorder where the sacrum is not formed properly; also motor neuron link, see PMIDs 21593306 and 17715199 | Gene alias is HLXB9 and it causes Currarino syndrome (also Currarino triad) is an inherited congenital disorder where the sacrum is not formed properly; also motor neuron link, see PMIDs 21593306 and 17715199 |

TABLE 3-continued

| Gene ID # | RefSeq Gene Symbol | CNV Gene Region | NCBI Gene ID | Gene Biology Curation | Gene Annotation |
|---|---|---|---|---|---|
| 192 | MOB3B | intronic | 79817 | Mps One Binder kinase activator-like 2B; RefSeq description: The protein encoded by this gene shares similarity with the yeast Mob1 protein. Yeast Mob1 binds Mps1p, a protein kinase essential for spindle pole body duplication and mitotic checkpoint regulation. This gene is located on the opposite strand as the interferon kappa precursor (IFNK) gene. | Mps One Binder kinase activator-like 2B; RefSeq description: The protein encoded by this gene shares similarity with the yeast Mob1 protein. Yeast Mob1 binds Mps1p, a protein kinase essential for spindle pole body duplication and mitotic checkpoint regulation. This gene is located on the opposite strand as the interferon kappa precursor (IFNK) gene. |
| 193 | MOGAT3 | exonic | 346606 | Gene alias is MGAT3; see mouse model (PMID 11986323): Truncated, inactive N-acetylglucosaminyltransferase III (GlcNAc-TIII) induces neurological and other traits absent in mice that lack GlcNAc-TIII, abstract: "Mgat3(T37/T37) homozygotes in a mixed or 129(SvJ) background were retarded in growth rate and exhibited an altered leg clasp reflex, an altered gait, and defective nursing behavior" | Gene alias is MGAT3; see mouse model (PMID 11986323): Truncated, inactive N-acetylglucosaminyltransferase III (GlcNAc-TIII) induces neurological and other traits absent in mice that lack GlcNAc-TIII, abstract: "Mgat3(T37/T37) homozygotes in a mixed or 129(SvJ) background were retarded in growth rate and exhibited an altered leg clasp reflex, an altered gait, and defective nursing behavior" |
| 194 | MTHFD1L | both | 25902 | The protein encoded by this gene is involved in the synthesis of tetrahydrofolate (THF) in the mitochondrion. THF is important in the de novo synthesis of purines and thymidylate and in the regeneration of methionine from homocysteine. Several transcript variants encoding different isoforms have been found for this gene. | The protein encoded by this gene is involved in the synthesis of tetrahydrofolate (THF) in the mitochondrion. THF is important in the de novo synthesis of purines and thymidylate and in the regeneration of methionine from homocysteine. Several transcript variants encoding different isoforms have been found for this gene. |
| 195 | MTUS1 | exonic | 57509 | This gene encodes a protein which contains a C-terminal domain able to interact with the angiotensin II (AT2) receptor and a large coiled-coil region allowing dimerization. Multiple alternatively spliced transcript variants encoding different isoforms have been found for this gene. One of the transcript variants has been shown to encode a mitochondrial protein that acts as a tumor suppressor and participates in AT2 signaling pathways. Other variants may encode nuclear or transmembrane proteins but it has not been determined whether they also participate in AT2 signaling pathways. | This gene encodes a protein which contains a C-terminal domain able to interact with the angiotensin II (AT2) receptor and a large coiled-coil region allowing dimerization. Multiple alternatively spliced transcript variants encoding different isoforms have been shown to encode a mitochondrial protein that acts as a tumor suppressor and participates in AT2 signaling pathways. Other variants may encode nuclear or transmembrane proteins but it has not been determined whether they also participate in AT2 signaling pathways. |
| 196 | MYO3B | intronic | 140469 | myosin IIIB, limited gene information | myosin IIIB, limited gene information |
| 197 | NDUFA4L2 | exonic | 56901 | Aceview lists PARK2 as putative partner | |
| 198 | NFIC | intronic | 4782 | nuclear factor I/C (CCAAT-binding transcription factor); OMIM 600729 | nuclear factor I/C (CCAAT-binding transcription factor); OMIM 600729 |
| 199 | NFKB1 | exonic | 4790 | Previous study (PMID 12203044) did not find mutations in gene in PD cases, see also PMID 20977677 ("Indeed, √ē¬ ±-synuclein significantly reduces nuclear factor kappa B activation, which is completely quenched by dopamine treatment") AND there are several other relevant PMIDS as PubMed search "nuclear factor NF-kappa-B AND parkinson's" lists 71 refs | Previous study (PMID 12203044) did not find mutations in gene in PD cases, see also PMID 20977677 ("Indeed, √ē¬ ±-synuclein significantly reduces nuclear factor kappa B activation, which is completely quenched by dopamine treatment") AND there are several other relevant PMIDS as PubMed search "nuclear factor NF-kappa-B AND parkinson's" lists 71 refs |

TABLE 3-continued

| Gene ID # | RefSeq Gene Symbol | CNV Gene Region | NCBI Gene ID | Gene Biology Curation | Gene Annotation |
|---|---|---|---|---|---|
| 200 | NKAIN3 | intronic | 286183 | No gene information | Na+/K+ transporting ATPase interacting 3; limited gene information; expressed in testis and brain only, see OMIM 612872; via AceView InterPro: NKAIN (Na,K-Atpase INteracting) proteins are a family of evolutionary conserved transmembrane proteins that localise to neurons, that are critical for neuronal function, and that interact with the beta subunits, beta1 in vertebrates and beta in *Drosophila*, of Na,K-ATPase. NKAINs have highly conserved trans-membrane domains but otherwise no other characterised domains. NKAINs may function as subunits of pore or channel structures in neurons or they may affect the function of other membrane proteins. They are likely to function within the membrane bilayer |
| 201 | NLGN1 | intronic | 22871 | Neurological function, such as PMID 21056983: N-cadherin and neuroligins cooperate to regulate synapse formation in hippocampal cultures. | Neurological function, such as PMID 21056983: N-cadherin and neuroligins cooperate to regulate synapse formation in hippocampal cultures. |
| 202 | NLRP4 | exonic | 147945 | NLRP7 also nearby; neurological and PD link, see PMID 21209283 for NLRP4 and beclin1 link: NLRP4 negatively regulates autophagic processes through an association with beclin1; PD link via beclin1, PMID 20057503: The Parkinson-associated protein PINK1 interacts with Beclin1 and promotes autophagy (also PMID 21672589) | NLRP7 also nearby; neurological and PD link, see PMID 21209283 for NLRP4 and beclin1 link: NLRP4 negatively regulates autophagic processes through an association with beclin1; PD link via beclin1, PMID 20057503: The Parkinson-associated protein PINK1 interacts with Beclin1 and promotes autophagy (also PMID 21672589) |
| 203 | NLRP7 | exonic | 199713 | NLRP4 also nearby; OMIM 609661, role in hydatidiform moles | NLRP4 also nearby; OMIM 609661, role in hydatidiform moles |
| 204 | NRG1 | intronic | 3084 | Intron CNV but is a longer transcript variant, see NM_013962.2: The protein encoded by this gene was originally identified as a 44-kD glycoprotein that interacts with the NEU/ERBB2 receptor tyrosine kinase to increase its phosphorylation on tyrosine residues; link to PD and AD see PMID 21517849, Systemic administration of neuregulin-1√e¬≤(1) protects dopaminergic neurons in a mouse model of Parkinson's disease | Intron CNV but is a longer transcript variant, see NM_013962.2; The protein encoded by this gene was originally identified as a 44-kD glycoprotein that interacts with the NEU/ERBB2 receptor tyrosine kinase to increase its phosphorylation on tyrosine residues; link to PD and AD see PMID 21517849, Systemic administration of neuregulin-1√e¬≤(1) protects dopaminergic neurons in a mouse model of Parkinson's disease |
| 205 | NRG3 | intronic | 10718 | neuregulin 3; schizophrenia, bipolar disorder, ADHD links; schizophrenia and nicotine link (PMID 18784291) | neuregulin 3; schizophrenia, bipolar disorder, ADHD links; schizophrenia and nicotine link (PMID 18784291) |
| 206 | NRXN3 | intronic | 9369 | AD link, see PMID 21084300: Processing of the synaptic cell adhesion molecule neurexin-3beta by Alzheimer disease alpha- and gamma-secretases | AD link, see PMID 21084300: Processing of the synaptic cell adhesion molecule neurexin-3beta by Alzheimer disease alpha- and gamma-secretases |
| 207 | NSL1 | exonic | 25936 | Centromere function, see PMID 20231385: Inner centromere formation requires hMis14, a trident kinetochore protein that specifically recruits HP1 to human chromosomes | Centromere function, see PMID 20231385: Inner centromere protein that specifically recruits HP1 to human chromosomes |
| 208 | NTF3 | both | 4908 | 42 PubMed refs for "neurotrophin-3 AND Parkinson's", such as PMID 20698822, Monoamine oxidase inhibitors as neuroprotective agents in age-dependent neurodegenerative disorders; see also | 42 PubMed refs for "neurotrophin-3 AND Parkinson's", such as PMID 20698822, Monoamine oxidase inhibitors as neuroprotective agents in age-dependent neurodegenerative disorders; see also http://en.wikipedia.org/wiki/Neurotrophin: "Neurotrophin-3, or NT-3, is a neurotrophic factor, in the NGF- |

TABLE 3-continued

| Gene ID # | RefSeq Gene Symbol | CNV Gene Region | NCBI Gene ID | Gene Biology Curation | Gene Annotation |
|---|---|---|---|---|---|
| | | | | http://en.wikipedia.org/wiki/Neurotrophin: "Neurotrophin-3, or NT-3, is a neurotrophic factor, in the NGF-family of neurotrophins. It is a protein growth factor that has activity on certain neurons of the peripheral and central nervous system; it helps to support the survival and differentiation of existing neurons, and encourages the growth and differentiation of new neurons and synapses. NT-3 is the third neurotrophic factor to be characterized, after NGF and BDNF. NT-3 is unique among the neurotrophins in the number of neurons it has potential to stimulate, given its ability to activate two of the receptor tyrosine kinase neurotrophin receptors (TrkC and TrkB). Mice born without the ability to make NT-3 have loss of proprioceptive and subsets of mechanoreceptive sensory neurons." | family of neurotrophins. It is a protein growth factor that has activity on certain neurons of the peripheral and central nervous system; it helps to support the survival and differentiation of existing neurons, and encourages the growth and differentiation of new neurons and synapses. NT-3 is the third neurotrophic factor to be characterized, after NGF and BDNF. NT-3 is unique among the neurotrophins in the number of neurons it has potential to stimulate, given its ability to activate two of the receptor tyrosine kinase neurotrophin receptors (TrkC and TrkB). Mice born without the ability to make NT-3 have loss of proprioceptive and subsets of mechanoreceptive sensory neurons." |
| 209 | NTF4 | exonic | 4909 | 10 PubMed refs for "neurotrophin-4 AND Parkinson's" such as PMID 7908342: Neurotrophin-4/5 is a survival factor for embryonic midbrain dopaminergic neurons in enriched cultures and PMID 19789989 (Liquiritin is a traditional Chinese medicine): Liquiritin potentiate neurite outgrowth induced by nerve growth factor in PC12 cells.; see also http://en.wikipedia.org/wiki/Neurotrophin: Neurotrophin-4 (NT-4) is a neurotrophic factor that signals predominantly through the TrkB receptor tyrosine kinase. It is also known as NT4, NT5, NT4, NT5, NTF4, and NT-4/5; also from RefSeq gene descr.: While knock-outs of other neurotrophins including nerve growth factor, brain-derived neurotrophic factor, and neurotrophin 3 prove lethal during early postnatal development, NTF5-deficient mice only show minor cellular deficits and develop normally to adulthood. | 10 PubMed refs for "neurotrophin-4 AND Parkinson's" such as PMID 7908342: Neurotrophin-4/5 is a survival factor for embryonic midbrain dopaminergic neurons in enriched cultures and PMID 19789989 (Liquiritin is a traditional Chinese medicine): Liquiritin potentiate neurite outgrowth induced by nerve growth factor in PC12 cells.; see also http://en.wikipedia.org/wiki/Neurotrophin: Neurotrophin-4 (NT-4) is a neurotrophic factor that signals predominantly through the TrkB receptor tyrosine kinase. It is also known as NT4, NT5, NTF4, and NT-4/5; also from RefSeq gene descr.: While knock-outs of other neurotrophins including nerve growth factor, brain-derived neurotrophic factor, and neurotrophin 3 prove lethal during early postnatal development, NTF5-deficient mice only show minor cellular deficits and develop normally to adulthood. |
| 210 | NXPH4 | exonic | 11247 | Neurological link (PMID 9856994); NXPHs are neuropeptides that bind to NRXNs; see NXPH4 in patent appl: http://www.faqs.org/patents/app/20090131265 | Neurological link (PMID 9856994); NXPHs are neuropeptides that bind to NRXNs; see NXPH4 in patent appl: http://www.faqs.org/patents/app/20090131265 |
| 211 | PAK2 | exonic | 5062 | PAK2 linked to PD via LRRK2 (see PMIDs 21454543, 17883396, 17314138, 19103160) | PAK2 linked to PD via LRRK2 (see PMIDs 21454543, 17883396, 17314138, 19103160) |
| 212 | PARVB | exonic | 29780 | possible neurological/PD link via other genes, see PMID 12499396: Interaction of alphaPIX (ARHGEF6) with beta-parvin (PARVB) suggests an involvement of alphaPIX in integrin-mediated signaling; also link between | possible neurological/PD link via other genes, see PMID 12499396: Interaction of alphaPIX (ARHGEF6) with beta-parvin (PARVB) suggests an involvement of alphaPIX in integrin-mediated signaling; also link between PARVB and ILK, which is linked to GSK-3B, a PD Rx target (e.g., see PMIDs 15467740, |

TABLE 3-continued

| Gene ID # | RefSeq Gene Symbol | CNV Gene Region | NCBI Gene ID | Gene Biology Curation | Gene Annotation |
|---|---|---|---|---|---|
| 213 | PCBD2 | intronic | 84105 | PARVB and ILK, which is linked to GSK-3B, a PD Rx target (e.g., see PMIDs 15467740, 17182785, 17490631) | |
| 214 | PCDHA1 | exonic | 56147 | pterin-4 alpha-carbinolamine dehydratase/dimerization cofactor of hepatocyte nuclear factor 1 alpha (TCF1) 2; limited gene information, OMIM 609836 | pterin-4 alpha-carbinolamine dehydratase/dimerization cofactor of hepatocyte nuclear factor 1 alpha (TCF1) 2; limited gene information, OMIM 609836 |
| 215 | PCDHA10 | exonic | 56139 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| 216 | PCDHA2 | exonic | 56146 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| 217 | PCDHA3 | exonic | 56145 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| 218 | PCDHA4 | exonic | 56144 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| 219 | PCDHA5 | exonic | 56143 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| 220 | PCDHA6 | exonic | 56142 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| 221 | PCDHA7 | exonic | 56141 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| 222 | PCDHA8 | exonic | 56140 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| 223 | PCDHA9 | exonic | 9752 | protocadherin alpha genes overlap; neuro function, PMID 19625505: Protocadherin-alpha family is required for serotonergic projections to appropriately innervate target brain areas | protocadherin alpha genes overlap; neuro function, PMID 19625505: Protocadherin-alpha family is required for serotonergic projections to appropriately innervate target brain areas |
| 224 | PCM1 | exonic | 5108 | Downregulation of PCM1 affects axon formation (PMID 20685982), also has schizophrenia link | Downregulation of PCM1 affects axon formation (PMID 20685982), also has schizophrenia link |

TABLE 3-continued

| Gene ID # | RefSeq Gene Symbol | CNV Gene Region | NCBI Gene ID | Gene Biology Curation | Gene Annotation |
|---|---|---|---|---|---|
| 225 | PHACTR2 | intronic | 9749 | phosphatase and actin regulator 2; PHACTR2 was identified in PD GWAS (rs11155313, OR = ~1.3), see PMID 19429005: Phactr2 and Parkinson's disease | phosphatase and actin regulator 2; PHACTR2 was identified in PD GWAS (rs11155313, OR = ~1.3), see PMID 19429005: Phactr2 and Parkinson's disease |
| 226 | PIGZ | exonic | 80235 | AD link between PIGZ and QPRT (involved in kynurenine pathway, see PMID 21687761, which is linked to PD), see PMID 21054826: Viable mouse gene ablations that robustly alter brain Aβ¬s levels are rare | AD link between PIGZ and QPRT (involved in kynurenine pathway, see PMID 21687761, which is linked to PD), see PMID 21054826: Viable mouse gene ablations that robustly alter brain Aβ¬s levels are rare |
| 227 | PITPNC1 | intronic | 26207 | This gene encodes a member of the phosphatidylinositol transfer protein family. The encoded cytoplasmic protein transfers phosphatidylinositol from one membrane compartment to another; see also PMID 21728994 | This gene encodes a member of the phosphatidylinositol transfer protein family. The encoded cytoplasmic protein transfers phosphatidylinositol from one membrane compartment to another; see also PMID 21728994 |
| 228 | PITPNM3 | exonic | 83394 | Causes autosomal dominant cone dystrophy (OMIM 608921) | Causes autosomal dominant cone dystrophy (OMIM 608921) |
| 229 | PKD1L3 | exonic | 342372 | Gene function linked to taste, and both taste and smell are sometimes impaired in PD patients (51 PubMed refs for "taste AND parkinson's", e.g., see PMIDs 2119322, 20736182, 18606556 | Gene function linked to taste, and both taste and smell are sometimes impaired in PD patients (51 PubMed refs for "taste AND parkinson's", e.g., see PMIDs 2119322, 20736182, 18606556 |
| 230 | PLCL1 | both | 5334 | PMID 19996098: Phospholipase C-related but catalytically inactive protein is required for insulin-induced cell surface expression of gamma-aminobutyric acid type A receptors.; which is also identified as molecular marker in gene expression PD patent (http://www.faqs.org/patents/app/20100221735) | PMID 19996098: Phospholipase C-related but catalytically inactive protein is required for insulin-induced cell surface expression of gamma-aminobutyric acid type A receptors.; which is also identified as molecular marker in gene expression PD patent (http://www.faqs.org/patents/app/20100221735) |
| 231 | PLD1 | intronic | 5337 | PD link, see PMID 9538008: Regulation of phospholipase D2: selective inhibition of mammalian phospholipase D isoenzymes by alpha- and beta-synucleins. | PD link, see PMID 9538008: Regulation of phospholipase D2: selective inhibition of mammalian phospholipase D isoenzymes by alpha- and beta-synucleins. |
| 232 | PLOD3 | exonic | 8985 | The protein encoded by this gene is a membrane-bound homodimeric enzyme that is localized to the cisternae of the rough endoplasmic reticulum. The enzyme (cofactors iron and ascorbate) catalyzes the hydroxylation of lysyl residues in collagen-like peptides. The resultant hydroxylysyl groups are attachment sites for carbohydrates in collagen and thus are critical for the stability of intermolecular crosslinks Some patients with Ehlers-Danlos syndrome type VIB have deficiencies in lysyl hydroxylase activity. | The protein encoded by this gene is a membrane-bound homodimeric enzyme that is localized to the cisternae of the rough endoplasmic reticulum. The enzyme (cofactors iron and ascorbate) catalyzes the hydroxylation of lysyl residues in collagen-like peptides. The resultant hydroxylysyl groups are attachment sites for carbohydrates in collagen and thus are critical for the stability of intermolecular crosslinks Some patients with Ehlers-Danlos syndrome type VIB have deficiencies in lysyl hydroxylase activity. |
| 233 | POLR3A | exonic | 11128 | The protein encoded by this gene is the catalytic component of RNA polymerase III, which synthesizes small RNAs. The encoded protein also acts as a sensor to detect foreign DNA and trigger an innate immune response. | The protein encoded by this gene is the catalytic component of RNA polymerase III, which synthesizes small RNAs. The encoded protein also acts as a sensor to detect foreign DNA and trigger an innate immune response. |
| 234 | POM121L1P | exonic | 25812 | No gene information | This locus appears to be a pseudogene related to DKFZp434K191, which is of unknown function. This pseudogene lies in the |

TABLE 3-continued

| Gene ID # | RefSeq Gene Symbol | CNV Gene Region | NCBI Gene ID | Gene Biology Curation | Gene Annotation |
|---|---|---|---|---|---|
| | | | | | immunoglobulin lambda gene cluster on chromosome 22q11.21. [provided by RefSeq, July 2008]. Sequence Note: The RefSeq transcript was derived from genomic sequence to make the sequence consistent with the reference genome assembly. The genomic coordinates used for the transcript record were based on alignments. |
| 235 | PPIL4 | exonic | 85313 | Gene is peptidylprolyl isomerase (cyclophilin)-like 4 and little known about it, but PMID 11978968 abstract states: The cyclophilins are members of a highly conserved, ubiquitous family, and play an important role in protein folding, immunosuppression by cyclosporin A (CsA), and infection of HIV-1 virions; in general searches 7 refs for PubMed search '"peptidylprolyl isomerase" AND parkinson's', such as PMID 16365047: Prolyl-isomerase Pin1 accumulates in lewy bodies of parkinson disease and facilitates formation of alpha-synuclein inclusions; also, 28 refs for PubMed search "FK506-binding protein AND Parkinson's" such as PMID 21652707: Comparative Analysis of Different Peptidyl-Prolyl Isomerases Reveals FK506-binding Protein 12 as the Most Potent Enhancer of {alpha}-Synuclein Aggregation; PMID 21553017: Unraveling the role of peptidyl-prolyl isomerases in neurodegeneration | Gene is peptidylprolyl isomerase (cyclophilin)-like 4 and little known about it, but PMID 11978968 abstract states: The cyclophilins are members of a highly conserved, ubiquitous family, and play an important role in protein folding, immunosuppression by cyclosporin A (CsA), and infection of HIV-1 virions; in general searches 7 refs for PubMed search '"peptidylprolyl isomerase" AND parkinson's', such as PMID 16365047: Prolyl-isomerase Pin1 accumulates in lewy bodies of parkinson disease and facilitates formation of alpha-synuclein inclusions; also, 28 refs for PubMed search "FK506-binding protein AND Parkinson's" such as PMID 21652707: Comparative Analysis of Different Peptidyl-Prolyl Isomerases Reveals FK506-binding Protein 12 as the Most Potent Enhancer of {alpha}-Synuclein Aggregation; PMID 21553017: Unraveling the role of peptidyl-prolyl isomerases in neurodegeneration |
| 236 | PRAME | exonic | 23532 | melanoma antigen preferentially expressed in tumors | This gene encodes an antigen that is predominantly expressed in human melanomas and that is recognized by cytolytic T lymphocytes. It is not expressed in normal tissues, except testis. This expression pattern is similar to that of other CT antigens, such as MAGE, BAGE and GAGE. However, unlike these other CT antigens, this gene is also expressed in acute leukemias. Five alternatively spliced transcript variants encoding the same protein have been observed for this gene. [provided by RefSeq, July 2008]. Transcript Variant: This variant (1) lacks a segment in the 5' UTR compared to the longest variant (2). Both variants encode the same protein. Publication Note: This RefSeq record includes a subset of the publications that are available for this gene. Please see the Gene record to access additional publications. ##RefSeq-Attributes-START## Transcript_exon_combination_evidence :: U65011.1 [ECO: 0000332] ##RefSeq-Attributes-END## |
| 237 | PREPL | exonic | 9581 | PREPL (OMM 609557) causes hyptonia-cystinuria syndrome (OMIM 606407) involving SLCA1 and/or PREPL; see also PMIDS 16385448, 17579669, 18234729, 18781961, 21686663, 21222627; see PMID 21692504 for potential as drug target | PREPL (OMIM 609557) causes hyptonia-cystinuria syndrome (OMIM 606407) involving SLCA1 and/or PREPL; see also PMIDS 16385448, 17579669, 18234729, 18781961, 21686663, 21222627; see PMID 21692504 for potential as drug target |
| 238 | PROSC | exonic | 11212 | Gene is proline synthetase co-transcribed homolog (bacterial) and no info on function but CNV found in 2 of 87 PD cases and 0 of 1005 Normals | Gene is proline synthetase co-transcribed homolog (bacterial) and no info on function but CNV found in 2 of 87 PD cases and 0 of 1005 Normals |

TABLE 3-continued

| Gene ID # | RefSeq Gene Symbol | CNV Gene Region | NCBI Gene ID | Gene Biology Curation | Gene Annotation |
|---|---|---|---|---|---|
| 239 | PRTN3 | exonic | 5657 | proteinase 3 (OMIM 177020) | proteinase 3 (OMIM 177020) |
| 240 | PSD3 | intronic | 23362 | Gene aliases EFA6R and HCA67; pleckstrin and Sec7 domain containing 3; cancer link, limited gene information | Gene aliases EFA6R and HCA67; pleckstrin and Sec7 domain containing 3; cancer link, limited gene information |
| 241 | PTP4A3 | exonic | 11156 | The protein encoded by this gene belongs to a small class of prenylated protein tyrosine phosphatases (PTPs). PTPs are cell signaling molecules that play regulatory roles in a variety of cellular processes. This class of PTPs contain a PTP domain and a characteristic C-terminal prenylation motif. Studies of this class of PTPs in mice demonstrated that they were prenylated proteins in vivo, which suggested their association with cell plasma membrane. Overexpression of this gene in mammalian cells was reported to inhibit angiotensin-II induced cell calcium mobilization and promote cell growth. Two alternatively spliced variants exist. | The protein encoded by this gene belongs to a small class of prenylated protein tyrosine phosphatases (PTPs). PTPs are cell signaling molecules that play regulatory roles in a variety of cellular processes. This class of PTPs contain a PTP domain and a characteristic C-terminal prenylation motif. Studies of this class of PTPs in mice demonstrated that they were prenylated proteins in vivo, which suggested their association with cell plasma membrane. Overexpression of this gene in mammalian cells was reported to inhibit angiotensin-II induced cell calcium mobilization and promote cell growth. Two alternatively spliced variants exist. |
| 242 | PTPRA | exonic | 5786 | PD link and neurological link, see PMID 7691597: Receptor protein tyrosine phosphatase alpha activates pp60c-src and is involved in neuronal differentiation; abstract indicates functional role of pp60c-src (SRC) and SRC is linked to PD (20 PubMed citations for 'SRC AND Parkinson's") | PD link and neurological link, see PMID 7691597: Receptor protein tyrosine phosphatase alpha activates pp60c-src and is involved in neuronal differentiation; abstract indicates functional role of pp60c-src (SRC) and SRC is linked to PD (20 PubMed citations for 'SRC AND Parkinson's'") |
| 243 | PTPRC | exonic | 5788 | OMIM 151460; PD link for beta and zeta versions of receptor (PMIDs 21375485, 19548869, 17368428), see also PMID 12435803 | OMIM 151460; PD link for beta and zeta versions of receptor (PMIDs 21375485, 19548869, 17368428), see also PMID 12435803 |
| 244 | PTPRD | intronic | 5789 | Studies of the similar genes in chicken and fly suggest the role of this PTP is in promoting neurite growth, and regulating neurons axon guidance; neurological role in mouse model (OMIM 601598) | Studies of the similar genes in chicken and fly suggest the role of this PTP is in promoting neurite growth, and regulating neurons axon guidance; neurological role in mouse model (OMIM 601598) |
| 245 | PTPRO | both | 5800 | OMIM 600579 indicates its role in kidney disease, see also PMID 21722858: Disruption of PTPRO Causes Childhood-Onset Nephrotic Syndrome; neurological/PD link unknown but occurs in 2-3 PD cases and 0 in 1005 Normals | OMIM 600579 indicates its role in kidney disease, see also PMID 21722858: Disruption of PTPRO Causes Childhood-Onset Nephrotic Syndrome; neurological/PD link unknown but occurs in 2-3 PD cases and 0 in 1005 Normals |
| 246 | PUF60 | exonic | 22827 | Protein encoded by this gene is a Ro RNP-binding protein. It interacts with Ro RNPs and their interaction is thought to represent a gain of function for Ro RNPs. This protein also forms a ternary complex with far upstream element (FUSE) and FUSE-binding protein; limited gene information; splicing factor (PMID 18974054) | Protein encoded by this gene is a Ro RNP-binding protein. It interacts with Ro RNPs and their interaction is thought to represent a gain of function for Ro RNPs. This protein also forms a ternary complex with far upstream element (FUSE) and FUSE-binding protein; limited gene information; splicing factor (PMID 18974054) |
| 247 | RALYL | both | 138046 | RALY RNA binding protein-like, implicated via yeast 2-hybrid screen as binding partner of LRRK2, see PMID 19001729: Screening of LRRK2 interactants by yeast 2-hybrid analysis | RALY RNA binding protein-like, implicated via yeast 2-hybrid screen as binding partner of LRRK2, see PMID 19001729: Screening of LRRK2 interactants by yeast 2-hybrid analysis |
| 248 | RASA3 | exonic | 22821 | RAS p21 protein activator 3 and is a GAP1 family member; MAPK link (PMID 18952607) | RAS p21 protein activator 3 and is a GAP1 family member; MAPK link (PMID 18952607) |

TABLE 3-continued

| Gene ID # | RefSeq Gene Symbol | CNV Gene Region | NCBI Gene ID | Gene Biology Curation / Gene Annotation |
|---|---|---|---|---|
| 249 | RASSF3 | intronic | 283349 | Ras association (RalGDS/AF-6) domain family member 3; cancer link (OMIM 607019) |
| 250 | RBFOX1 | intronic | 54715 | Several neurological links, such as PMID 21623373; Ataxin-2 binding protein 1 has an RNP motif that is highly conserved among RNA-binding proteins. This protein binds to the C-terminus of ataxin-2 and may contribute to the restricted pathology of spinocerebellar ataxia type 2 (SCA2). PD-specific CNVs also found in CAMTA1 (Regulated by RBFOX1 in mouse, see PMID 21623373) |
| 251 | RBM25 | intronic | 58517 | RNA binding motif protein 25; splicing cofactor (PMID 18663000) |
| 252 | RBM27 | both | 54439 | RNA binding motif protein 27; limited gene information |
| 253 | RELL1 | exonic | 768211 | Limited gene info; RELT-like 1 (OMIM 611212); role in oxidative stress, see PMID 16389068: Identification of RELT homologues that associate with RELT and are phosphorylated by OSR1. |
| 254 | RGS6 | intronic | 9628 | PMID 12140291: RGS6 interacts with SCG10 and promotes neuronal differentiation. Role of the G gamma subunit-like (GGL) domain of RGS6; PD-specific CNVs in RGS7 |
| 255 | RGS7 | exonic | 6000 | RGS7 has neurological links and MIR3123 overlap this gene; see also GPR20 entry (PMID 21343290: Gi/o signaling and the palmitoyltransferase DHHC2 regulate palmitate cycling and shuttling of RGS7 family-binding protein); 2 PubMed refs for "regulator of G-protein signaling 7 AND Parkinson's": RGS9 direct PD link, PMID 15728856:D2 dopamine receptors colocalize regulator of G-protein signaling 9-2 (RGS9-2) via the RGS9 DEP domain, and RGS9 knock-out mice develop dyskinesias associated with dopamine pathways and PMID 21323908: Cannabinoid receptor signalling in neurodegenerative diseases: a potential role for membrane fluidity disturbance; PD-specific CNVs in RGS6 |
| 256 | RIMS1 | intronic | 22999 | regulating synaptic membrane exocytosis 1; Aceview summary: "The protein encoded by this gene is a RAS gene superfamily member that regulates synaptic vesicle exocytosis. The encoded protein may be part of the protein scaffold of the cell. Defects in this gene are a cause of cone-rod dystrophy type 7 (CORD7)"; see also review PMID 21922075: Pushing synaptic vesicles over the RIM; RIMS2 also impacted by CNV-specific CNVs; a PD-specific intronic CNV in 1 PD case has also been found in RIMS2 |

TABLE 3-continued

| Gene ID # | RefSeq Gene Symbol | CNV Gene Region | NCBI Gene ID | Gene Biology Curation | Gene Annotation |
|---|---|---|---|---|---|
| 257 | RNF130 | exonic | 55819 | intronic CNV in 1 PD case has also been found in RIMS2 Protein product for RNF130 is E3 ubiquitin-protein ligase RNF130 precursor, which may be analogous to Parkin (PARK2) via its classification as RBR family member (see review PMID 15152079) | Protein product for RNF130 is E3 ubiquitin-protein ligase RNF130 precursor, which may be analogous to Parkin (PARK2) via its classification as RBR family member (see review PMID 15152079) |
| 258 | RNF144B | both | 255488 | Gene aliases are bA528A10.3; IBRDC2; KIAA0161; MGC71786; p53RFP; PIR2; other RNFs in this list and see review on RBR family (PMID 15152079); PMID 20300062 links RNF144B to BAX and BAX linked to PD, see PMID 14596892: BAX protein-immunoreactivity in midbrain neurons of Parkinson's disease patients | Gene aliases are bA528A10.3; IBRDC2; KIAA0161; MGC71786; p53RFP; PIR2; other RNFs in this list and see review on RBR family (PMID 15152079); PMID 20300062 links RNF144B to BAX and BAX linked to PD, see PMID 14596892: BAX protein-immunoreactivity in midbrain neurons of Parkinson's disease patients |
| 259 | RNF217 | exonic | 154214 | Other family members (RNF144B and RNF4) have CNVs detected in PD cases only; AceView indicates it contains IBR protein domain, which is found in: ANKIB1, ARIH1, ARIH2, CUL9, FBXO43, PARK2, RNF14, RNF19A, RNF19B, RNF144A, RNF144B, RNF217 | Other family members (RNF144B and RNF4) have CNVs detected in PD cases only; AceView indicates it contains IBR protein domain, which is found in: ANKIB1, ARIH1, ARIH2, CUL9, FBXO43, PARK2, RNF14, RNF19A, RNF19B, RNF144A, RNF144B, RNF217 |
| 260 | RNF4 | exonic | 6047 | OMIM 602850, indicates RNF4 is a SUMO-specific E3 ubiquitin ligase; PMID 20696907 abstract also indicates that RNF4 "may serve as a direct link between epigenetic DNA demethylation and DNA repair in mammalian cells" | OMIM 602850, indicates RNF4 is a SUMO-specific E3 ubiquitin ligase; PMID 20696907 abstract also indicates that RNF4 "may serve as a direct link between epigenetic DNA demethylation and DNA repair in mammalian cells" |
| 261 | RNPC3 | exonic | 55599 | Aceview lists this complex region as a single gene (RNPC3andAMY2B); RNA-binding region (RNP1, RRM) containing 3 | Aceview lists this complex region as a single gene (RNPC3andAMY2B); RNA-binding region (RNP1, RRM) containing 3 |
| 262 | ROCK1 | exonic | 6093 | Amyloid link, see PMID 14615541: Zhou et al. (2003) concluded that the Rho-Rock pathway may regulate amyloid precursor protein processing, and a subset of NSAIDs can reduce A-beta(42) through inhibition of Rho activity; see SGK1, which has CNV occuring in 7 of 87 PD cases and 0 of 1005 Normals, ROCK1 shows up in same therapeutics patents directed at kinases | Amyloid link, see PMID 14615541: Zhou et al. (2003) concluded that the Rho-Rock pathway may regulate amyloid precursor protein processing, and a subset of NSAIDs can reduce A-beta(42) through inhibition of Rho activity; see SGK1, which has CNV occuring in 7 of 87 PD cases and 0 of 1005 Normals, ROCK1 shows up in same therapeutics patents directed at kinases |
| 263 | RORA | intronic | 6095 | RAR-related orphan receptor A; limited gene information, but see OMIM (600825) indicates RORA maps to locus in mouse 'staggerer' mouse model(PMID 13912552), which has phenotype: 'The "staggerer" mutant is recognized by its staggering gait, mild tremor, hypotonia, and small size. Symptoms develop during postnatal weeks 1 to 4 and remain stationary thereafter. The cerebellar cortex is grossly underdeveloped, with too few granule cells and unaligned Purkinje cells.' | RAR-related orphan receptor A: limited gene information, but see OMIM (600825) indicates RORA maps to locus in mouse 'staggerer' mouse model(PMID 13912552), which has phenotype: 'The "staggerer" mutant is recognized by its staggering gait, mild tremor, hypotonia, and small size. Symptoms develop during postnatal weeks 1 to 4 and remain stationary thereafter. The cerebellar cortex is grossly underdeveloped, with too few granule cells and unaligned Purkinje cells.' |

TABLE 3-continued

| Gene ID # | RefSeq Gene Symbol | CNV Gene Region | NCBI Gene ID | Gene Biology Curation | Gene Annotation |
|---|---|---|---|---|---|
| 264 | RPL35A | exonic | 6165 | ribosomal protein L35a, limited gene information but see PMID 20378560, Mutations in the ribosomal protein genes in Japanese patients with Diamond-Blackfan anemia; OMIM 612528 | ribosomal protein L35a, limited gene information but see PMID 20378560, Mutations in the ribosomal protein genes in Japanese patients with Diamond-Blackfan anemia; OMIM 612528 |
| 265 | RPS24 | exonic | 6229 | This gene encodes a ribosomal protein that is a component of the 40S subunit. The protein belongs to the S24E family of ribosomal proteins. It is located in the cytoplasm. Multiple transcript variants encoding different isoforms have been found for this gene. As is typical for genes encoding ribosomal proteins, there are multiple processed pseudogenes of this gene dispersed through the genome. Mutations in this gene result in Diamond-Blackfan anemia. | This gene encodes a ribosomal protein that is a component of the 40S subunit. The protein belongs to the S24E family of ribosomal proteins. It is located in the cytoplasm. Multiple transcript variants encoding different isoforms have been found for this gene. As is typical for genes encoding ribosomal proteins, there are multiple processed pseudogenes of this gene dispersed through the genome. Mutations in this gene result in Diamond-Blackfan anemia. |
| 266 | RPS6KC1 | intronic | 26750 | Gene aliases humS6PKh1 and RPK118; link to PD, RPS6KC1 interacts with PRDX3 (PMID 15750338) which interacts with LRRK2 (PMID 21850687) | Gene aliases humS6PKh1 and RPK118; link to PD, RPS6KC1 interacts with PRDX3 (PMID 15750338) which interacts with LRRK2 (PMID 21850687) |
| 267 | RTTN | both | 25914 | rotatin; limited gene information, see PMIDs 11900971 and 17551791, "Embryos deficient in rotatin show also randomized heart looping and delayed neural tube closure, and fail to undergo the critical morphogenetic step of axial rotation" | rotatin; limited gene information, see PMIDs 11900971 and 17551791, "Embryos deficient in rotatin show also randomized heart looping and delayed neural tube closure, and fail to undergo the critical morphogenetic step of axial rotation" |
| 268 | SCAMP1 | intronic | 9522 | This gene product belongs to the SCAMP family of proteins which are secretory carrier membrane proteins. They function as carriers to the cell surface in post-golgi recycling pathways. | This gene product belongs to the SCAMP family of proteins which are secretory carrier membrane proteins. They function as carriers to the cell surface in post-golgi recycling pathways. |
| 269 | SENP5 | both | 205564 | SENP5 involved in mitochondrial defect (PMIDs 17102611, 17341580, 20131004) which is PARK2 and PINK1 mechanism | SENP5 involved in mitochondrial defect (PMIDs 17102611, 17341580, 20131004) which is PARK2 and PINK1 mechanism |
| 270 | SEPT14 | exonic | 346288 | PD link, PMID 20236126: "Expression changes in septins have also been associated with neurological conditions such as Alzheimer's and Parkinson's disease, as well as retinopathies, hepatitis C, spermatogenesis and Listeria infection. Pathogenic mutations of SEPT9 were identified in the autosomal dominant neurological disorder hereditary neuralgic amyotrophy (HNA)"; see also PMID 18951507, "Expression of Lewy body protein septin 4 in postmortem brain of Parkinson's disease and control subjects"; PMID 19378812: "Functions of the septin cytoskeleton and its roles in dopaminergic neurotransmission"; PMID 20181826: "Septin 14 is involved in cortical neuronal migration via interaction with Septin 4"; 15 PubMed refs for "septin AND Parkinson's" including PMIDs 18541383, 19378812. | PD link, PMID 20236126: "Expression changes in septins have also been associated with neurological conditions such as Alzheimer's and Parkinson's disease, as well as retinopathies, hepatitis C, spermatogenesis and Listeria infection. Pathogenic mutations of SEPT9 were identified in the autosomal dominant neurological disorder hereditary neuralgic amyotrophy (HNA)"; see also PMID 18951507, "Expression of Lewy body protein septin 4 in postmortem brain of Parkinson's disease and control subjects"; PMID 19378812: "Functions of the septin cytoskeleton and its roles in dopaminergic neurotransmission"; PMID 20181826: "Septin 14 is involved in cortical neuronal migration via interaction with Septin 4"; 15 PubMed refs for "septin AND Parkinson's" including PMIDs 18541383, 19378812. |

TABLE 3-continued

| Gene ID # | RefSeq Gene Symbol | CNV Gene Region | NCBI Gene ID | Gene Biology Curation | Gene Annotation |
|---|---|---|---|---|---|
| 271 | SFRP1 | exonic | 6422 | Many cancer citations but neurological citation too, sucha as PMID 16172602: SFRP1 regulates the growth of retinal ganglion cell axons through the Fz2 receptor; SFRP1 involved in WNT signaling, 13 citations for "wnt signaling" AND parkinson's' and also mentioned in abstract for PD gene VPS35, PMID 21763482 | Many cancer citations but neurological citation too, sucha as PMID 16172602: SFRP1 regulates the growth of retinal ganglion cell axons through the Fz2 receptor; SFRP1 involved in WNT signaling, 13 citations for "wnt signaling" AND parkinson's' and also mentioned in abstract for PD gene VPS35, PMID 21763482 |
| 272 | SGK1 | exonic | 6446 | 3 PubMed for "SGK1 AND parkinson's" for PMIDs 15673431, 16125969, 20530112; many patents with SGK1 as kinase target, along with ROCK1 (1 PD case has ROCK1 CNV) | 3 PubMed for "SGK1 AND parkinson's" for PMIDs 15673431, 16125969, 20530112; many patents with SGK1 as kinase target, along with ROCK1 (1 PD case has ROCK1 CNV) |
| 273 | SHMT2 | exonic | 6472 | Potential role in mitochondrial integrity/dysfunction, see PMID 21876188, abstract states: "De novo thymidylate synthesis activity was diminished in mitochondria isolated from glyA CHO cells that lack SHMT2 activityv¢,Ç¯¯¶" | Potential role in mitochondrial integrity/dysfunction, see PMID 21876188, abstract states: "De novo thymidylate synthesis activity was diminished in mitochondria isolated from glyA CHO cells that lack SHMT2 activityv¢,Ç¯¯¶" |
| 274 | SLC25A24 | both | 29957 | nuclear gene encoding mitochondrial protein, transcript variant 2; potential PD via mito function | nuclear gene encoding mitochondrial protein, transcript variant 2; potential PD via mito function |
| 275 | SLC38A6 | both | 145389 | Limited gene information; expessed in brain (PMID 18418736) | Limited gene information; expessed in brain (PMID 18418736) |
| 276 | SLC39A8 | exonic | 64116 | This gene encodes a member of the SLC39 family of solute-carrier genes, which show structural characteristics of zinc transporters. The encoded protein is glycosylated and found in the plasma membrane and mitochondria, and functions in the cellular import of zinc at the onset of inflammation. It is also thought to be the primary transporter of the toxic cation cadmium, which is found in cigarette smoke. Multiple transcript variants encoding different isoforms have been found for this gene. Additional alternatively spliced transcript variants of this gene have been described, but their full-length nature is not known. | This gene encodes a member of the SLC39 family of solute-carrier genes, which show structural characteristics of zinc transporters. The encoded protein is glycosylated and found in the plasma membrane and mitochondria, and functions in the cellular import of zinc at the onset of inflammation. It is also thought to be the primary transporter of the toxic cation cadmium, which is found in cigarette smoke. Multiple transcript variants encoding different isoforms have been found for this gene. Additional alternatively spliced transcript variants of this gene have been described, but their full-length nature is not known. |
| 277 | SLC3A1 | exonic | 6519 | This gene encodes a type II membrane glycoprotein which is one of the components of the renal amino acid transporter which transports neutral and basic amino acids in the renal tubule and intestinal tract. Mutations and deletions in this gene are associated with cystinuria. Alternatively spliced transcript variants have been described, but their biological validity has not been determined | This gene encodes a type II membrane glycoprotein which is one of the components of the renal amino acid transporter which transports neutral and basic amino acids in the renal tubule and intestinal tract. Mutations and deletions in this gene are associated with cystinuria. Alternatively spliced transcript variants have been described, but their biological validity has not been determined |
| 278 | SLC9B1 | exonic | 150159 | The protein encoded by this gene is a sodium/hydrogen exchanger and transmembrane protein. Highly conserved orthologs of this gene have been found in other mammalian species. The expression of this gene may be limited to testis. Multiple transcript variants encoding different isoforms have been found for this gene. | The protein encoded by this gene is a sodium/hydrogen exchanger and transmembrane protein. Highly conserved orthologs of this gene have been found in other mammalian species. The expression of this gene may be limited to testis. Multiple transcript variants encoding different isoforms have been found for this gene. |

TABLE 3-continued

| Gene ID # | RefSeq Gene Symbol | CNV Gene Region | NCBI Gene ID | Gene Biology Curation | Gene Annotation |
|---|---|---|---|---|---|
| 279 | SLC9B2 | exonic | 133308 | different iso forms have been found for this gene. Sodium hydrogen antiporters, such as NHEDC2, convert the proton motive force established by the respiratory chain or the F1F0 mitochondrial ATPase into sodium gradients that drive other energy-requiring processes, transduce environmental signals into cell responses, or function in drug efflux (Xiang et al., 2007 [PubMed 18000046]). | Sodium hydrogen antiporters, such as NHEDC2, convert the proton motive force established by the respiratory chain or the F1F0 mitochondrial ATPase into sodium gradients that drive other energy-requiring processes, transduce environmental signals into cell responses, or function in drug efflux (Xiang et al., 2007 [PubMed 18000046]). |
| 280 | SMYD3 | exonic | 64754 | This gene encodes a histone methyltransferase which functions in RNA polymerase II complexes by an interaction with a specific RNA helicase. Multiple transcript variants encoding different isoforms have been found for this gene. | This gene encodes a histone methyltransferase which functions in RNA polymerase II complexes by an interaction with a specific RNA helicase. Multiple transcript variants encoding different isoforms have been found for this gene. |
| 281 | SPAG16 | both | 79582 | sperm associated antigen 16; limited gene information | sperm associated antigen 16; limited gene information |
| 282 | SPATA31A1 | exonic | 647060 | No gene information | SPATA31 subfamily A, member 1 (SPATA31A1) |
| 283 | SPATA31A2 | exonic | 642265 | No gene information | SPATA31 subfamily A, member 2 (SPATA31A2) |
| 284 | SPATA31A3 | exonic | 727830 | No gene information | SPATA31 subfamily A, member 3 (SPATA31A3) |
| 285 | SPATA31A4 | exonic | 642629 | No gene information | SPATA31 subfamily A, member 4 (SPATA31A4) |
| 286 | SPATA31A5 | exonic | 727905 | No gene information | SPATA31 subfamily A, member 5 (SPATA31A5) |
| 287 | SPATA31A6 | exonic | 389730 | No gene information | SPATA31 subfamily A, member 6 (SPATA31A6) |
| 288 | SPATA31A7 | exonic | 26165 | No gene information | SPATA31 subfamily A, member 7 (SPATA31A7) |
| 289 | SPON1 | intronic | 10418 | spondin 1, extracellular matrix protein; AD link, see PMID 14983046: Binding of F-spondin to amyloid-beta precursor protein: a candidate amyloid-beta precursor protein ligand that modulates amyloid-beta precursor protein cleavage; neuro link, see PMID 21145970: F-spondin regulates neuronal survival through activation of disabled-1 in the chicken ciliary ganglion | spondin 1, extracellular matrix protein; AD link, see PMID 14983046: Binding of F-spondin to amyloid-beta precursor protein: a candidate amyloid-beta precursor protein ligand that modulates amyloid-beta precursor protein cleavage; neuro link, see PMID 21145970: F-spondin regulates neuronal survival through activation of disabled-1 in the chicken ciliary ganglion |
| 290 | SRF | exonic | 6722 | SRF linked to FXN; downstream target of MAPK pathway; also, SRF linked to PD via Rho GTPase, see PMID 21699982: Rho GTPase regulation of √è¬ ±-synuclein and VMAT2: Implications for pathogenesis of Parkinson's disease | SRF linked to FXN; downstream target of MAPK pathway; also, SRF linked to PD via Rho GTPase, see PMID 21699982: Rho GTPase regulation of √è¬ ±-synuclein and VMAT2: Implications for pathogenesis of Parkinson's disease |
| 291 | SRGAP2 | exonic | 23380 | Neurological funtion, see PMID 19737524: The F-BAR domain of srGAP2 induces membrane protrusions required for neuronal migration and morphogenesis | Neurological funtion, see PMID 19737524: The F-BAR domain of srGAP2 induces membrane protrusions required for neuronal migration and morphogenesis |
| 292 | STAU2 | both | 27067 | Neurological links, see PMIDs 20596529, 21508097, 21635779; MAPK link, see PMIDs 16418534 and 17587311 | Neurological links, see PMIDs 20596529, 21508097, 21635779; MAPK link, see PMIDs 16418534 and 17587311 |
| 293 | STK31 | intronic | 56164 | serine/threonine kinase 31; gene is similar to a mouse gene that encodes a putative protein kinase with a tudor domain, and shows testis-specific expression | serine/threonine kinase 31; gene is similar to a mouse gene that encodes a putative protein kinase with a tudor domain, and shows testis-specific expression |

TABLE 3-continued

| Gene ID # | RefSeq Gene Symbol | CNV Gene Region | NCBI Gene ID | Gene Biology Curation | Gene Annotation |
|---|---|---|---|---|---|
| 294 | STRA6 | exonic | 64220 | See PMID 19309693: Phenotypic spectrum of STRA6 mutations (OMIM 610745): from Matthew-Wood syndrome to non-lethal anophthalmia; retinol link to PD: PMID 17592014, Retinoic acid counteracts developmental defects in the substantia nigra caused by Pitx3 deficiency; PMID 15359008: Retinoic acid signaling in the nervous system of adult vertebrates; PMID 21695257, Leucine-rich repeat kinase 2 modulates retinoic acid-induced neuronal differentiation of murine embryonic stem cells; AD Rx link (STRA6 binds RBP4), PMID 17001693: Retinoid receptors, transporters, and metabolizers as therapeutic targets in late onset Alzheimer disease. | See PMID 19309693: Phenotypic spectrum of STRA6 mutations (OMIM 610745): from Matthew-Wood syndrome to non-lethal anophthalmia; retinol link to PD: PMID 17592014, Retinoic acid counteracts developmental defects in the substantia nigra caused by Pitx3 deficiency; PMID 15359008: Retinoic acid signaling in the nervous system of adult vertebrates; PMID 21695257, Leucine-rich repeat kinase 2 modulates retinoic acid-induced neuronal differentiation of murine embryonic stem cells; AD Rx link (STRA6 binds RBP4), PMID 17001693: Retinoid receptors, transporters, and metabolizers as therapeutic targets in late onset Alzheimer disease. |
| 295 | STX8 | intronic | 9482 | syntaxin 8, protein is involved in protein trafficking from early to late endosomes via vesicle fusion and exocytosis; PD link for syntaxin in Drosophila model (PMID 17456438) and involved in formation of SNARE (PMID 20489724), see also OMIM 604203 | syntaxin 8, protein is involved in protein trafficking from early to late endosomes via vesicle fusion and exocytosis; PD link for syntaxin in Drosophila model (PMID 17456438) and involved in formation of SNARE (PMID 20489724), see also OMIM 604203 |
| 296 | STXBP5L | intronic | 9515 | syntaxin binding protein 5-like, limited gene information | syntaxin binding protein 5-like, limited gene information |
| 297 | SYT1 | intronic | 6857 | synaptotagmin I; PD link, see PMIDs 21576241, 16111820, 15033168 | synaptotagmin I; PD link, see PMIDs 21576241, 16111820, 15033168 |
| 298 | TAAR1 | exonic | 134864 | PD link, for example PMID 18083911: Trace amine-associated receptor 1 modulates dopaminergic activity; see also PMIDs 21670104, 18585080, 20976142, 16584120; numerous patent filings mention TAAR1 (e.g., BrainCells Inc. and Roche); see also PMID 18083911: Trace amine-associated receptor 1 modulates dopaminergic activity; link to DRD5 | PD link, for example PMID 18083911: Trace amine-associated receptor 1 modulates dopaminergic activity; see also PMIDs 21670104, 18585080, 20976142, 16584120; numerous patent filings mention TAAR1 (e.g., BrainCells Inc. and Roche); see also PMID 18083911: Trace amine-associated receptor 1 modulates dopaminergic activity; link to DRD5 |
| 299 | TACR3 | exonic | 6870 | Gene aliases are neurokinin B, NK-3R, NK3R, NKR, TACR3L; 5 citations for PubMed search "neuromedin-K receptor AND parkinson's" AND 95 USPTO appl. and 80 issued patents for "neurokinin 3 receptor" as it is a drug target by several pharma; role in PD for TAC3/TACR3, see PMID 18423 7765: Neurokinin B/NK3 receptors exert feedback inhibition on L-DOPA actions in the 6-OHDA lesion rat model of Parkinson's disease; see also PMIDs18021294, 8574643; TACR3's neuropeptide ligand (TAC3, NKB, neurokinin B) also linked to preeclampsia (PMID 10866201) | Gene aliases are neurokinin B, NK-3R, NK3R, NKR, TACR3L; 5 citations for PubMed search "neuromedin-K receptor AND parkinson's" AND 95 USPTO appl. and 80 issued patents for "neurokinin 3 receptor" as it is a drug target by several pharma; role in PD for TAC3/TACR3, see PMID 18423 7765: Neurokinin B/NK3 receptors exert feedback inhibition on L-DOPA actions in the 6-OHDA lesion rat model of Parkinson's disease; see also PMIDs18021294, 8574643; TACR3's neuropeptide ligand (TAC3, NKB, neurokinin B) also linked to preeclampsia (PMID 10866201) |
| 300 | TAMM41 | exonic | 132001 | No gene information | No gene information |
| 301 | TARS | exonic | 6897 | Gene product is threonyl-tRNA synthetase; 8 citations for PubMed search "trna synthetase" AND parkinson's', such as PMID 16135753: Accumulation of the authentic parkin substrate | Gene product is threonyl-tRNA synthetase; 8 citations for PubMed search "trna synthetase" AND parkinson's', such as PMID 16135753: Accumulation of the authentic parkin substrate aminoacyl-tRNA synthetase cofactor, p38/JTV-1, leads to |

TABLE 3-continued

| Gene ID # | RefSeq Gene Symbol | CNV Gene Region | NCBI Gene ID | Gene Biology Curation | Gene Annotation |
|---|---|---|---|---|---|
| 302 | TBCE | exonic | 6905 | aminoacyl-tRNA synthetase cofactor, p38/JTV-1, leads to catecholaminergic cell death; Cofactor E is one of four proteins (cofactors A, D, E, and C) involved in the pathway leading to correctly folded beta-tubulin from folding intermediates. Cofactors A and D are believed to play a role in capturing and stabilizing beta-tubulin intermediates in a quasi-native confirmation. Cofactor E binds to the cofactor D/beta-tubulin complex; interaction with cofactor C then causes the release of beta-tubulin polypeptides that are committed to the native state. Two transcript variants encoding the same protein have been found for this gene. | catecholaminergic cell death; Cofactor E is one of four proteins (cofactors A, D, E, and C) involved in the pathway leading to correctly folded beta-tubulin from folding intermediates. Cofactors A and D are believed to play a role in capturing and stabilizing beta-tubulin intermediates in a quasi-native confirmation. Cofactor E binds to the cofactor D/beta-tubulin complex; interaction with cofactor C then causes the release of beta-tubulin polypeptides that are committed to the native state. Two transcript variants encoding the same protein have been found for this gene. |
| 303 | TBK1 | exonic | 29110 | TBK1 binds TRAF3 (PMID 17327220); TBK1 also linked to AKT and mTOR (21464307, also PMID 19622833: Inhibition of mTOR signaling in Parkinson's disease prevents L-DOPA-induced dyskinesia) and long-established role in NFKB activation (PMID 10581243, signaling complex contains TRAF2, TANK, TBK1); TBK1 also linked to cullin (see FBXO18 entry for details on cullin) and IFN, see PMID 17015689: Involvement of the IkappaB kinase (IKK)-related kinases tank-binding kinase 1/IKKi and cullin-based ubiquitin ligases in IFN regulatory factor-3 degradation AND link between PD and MS, PMID 21881474: A coincidental case of young-onset Parkinson disease and multiple sclerosis AND PMID 21870889: Targeting progressive neuroaxonal injury: lessons from multiple sclerosis; XPOT may also contribute to pathology (loss-of-function) as the CNV impacting TBK1 also impacts XPOT | TBK1 binds TRAF3 (PMID 17327220); TBK1 also linked to AKT and mTOR (21464307, also PMID 19622833: Inhibition of mTOR signaling in Parkinson's disease prevents L-DOPA-induced dyskinesia) and long-established role in NFKB activation (PMID 10581243, signaling complex contains TRAF2, TANK, TBK1); TBK1 also linked to cullin (see FBXO18 entry for details on cullin) and IFN, see PMID 17015689: Involvement of the IkappaB kinase (IKK)-related kinases tank-binding kinase 1/IKKi and cullin-based ubiquitin ligases in IFN regulatory factor-3 degradation AND link between PD and IFN-gamma, see PMID 21572432: Interferon-√e¬≥ induces progressive nigrostriatal degeneration and basal ganglia calcification; PMID 21482445: Interferon-√e¬≥ plays a role in paraquat-induced neurodegeneration involving oxidative and proinflammatory pathways; potential link between PD and MS, PMID 21881474: A coincidental case of young-onset Parkinson disease and multiple sclerosis AND PMID 21870889: Targeting progressive neuroaxonal injury: lessons from multiple sclerosis; XPOT may also contribute to pathology (loss-of-function) as the CNV impacting TBK1 also impacts XPOT |
| 304 | TFB2M | exonic | 64216 | No gene information | No gene information |
| 305 | TMEM117 | intronic | 84216 | transmembrane protein 117; limited gene information | transmembrane protein 117; limited gene information |
| 306 | TMEM52 | exonic | 339456 | transmembrane protein 52 | transmembrane protein 52 |
| 307 | TNFRSF1A | intronic | 7132 | tumor necrosis factor receptor superfamily, member 1A, and is linked to several diseases including MS; general TNF superfamily link to PD, e.g., see PMID 21728035: Tumor Necrosis | tumor necrosis factor receptor superfamily, member 1A, and is linked to several diseases including MS; general TNF superfamily link to PD, e.g., see PMID 21728035: Tumor Necrosis Factor-alpha and the Roles it Plays in Homeostatic and Degenerative |

TABLE 3-continued

| Gene ID # | RefSeq Gene Symbol | CNV Gene Region | NCBI Gene ID | Gene Biology Curation | Gene Annotation |
|---|---|---|---|---|---|
| 308 | TPTE2P3 | exonic | 220115 | Factor-alpha and the Roles it Plays in Homeostatic and Degenerative Processes Within the Central Nervous System; TRAF genes also contain PD-specific CNVs | Processes Within the Central Nervous System; TRAF genes also contain PD-specific CNVs |
| 309 | TRAF3 | exonic | 7187 | gene is listed as pseudogene; transmembrane phosphoinositide 3-phosphatase and tensin homolog 2 pseudogene 3; limited information, AceView indicates it contains a C2 domain of PTEN tumour-suppressor protein | gene is listed as pseudogene; transmembrane phosphoinositide 3-phosphatase and tensin homolog 2 pseudogene 3; limited information, AceView indicates it contains a C2 domain of PTEN tumour-suppressor protein |
| 310 | TRIQK | both | 286144 | TRAF3 binds TBK1 (PMID 17327220); see review, PMID 21660053: Expanding TRAF function: TRAF3 as a tri-faced immune regulator; see also PMID 18040839 | TRAF3 binds TBK1 (PMID 17327220); see review, PMID 21660053: Expanding TRAF function: TRAF3 as a tri-faced immune regulator; see also PMID 18040839 |
| 311 | TRPM4 | exonic | 54795 | No gene information PD link, see PMID 21486760: "ICAN is likely to be mediated by a transient receptor potential (TRP) channel, and RT-PCR was used to confirm expression of TRPM2 and TRPM4 mRNA in substantia nigra pars compacta. We propose that ICAN is selectively activated during burst firing to boost NMDA currents and allow plateau potentials. This boost mechanism may render DA cells vulnerable to excitotoxicity."; see also PMID 17585083: Central role of TRPM4 channels in cerebral blood flow regulation.; see also reviews PMID 21804597: Transient receptor potential channels as therapeutic targets and PMID 15194117: TRP ion channels in the nervous system. | No gene information PD link, see PMID 21486760: "ICAN is likely to be mediated by a transient receptor potential (TRP) channel, and RT-PCR was used to confirm expression of TRPM2 and TRPM4 mRNA in substantia nigra pars compacta. We propose that ICAN is selectively activated during burst firing to boost NMDA currents and allow plateau potentials. This boost mechanism may render DA cells vulnerable to excitotoxicity."; see also PMID 17585083: Central role of TRPM4 channels in cerebral blood flow regulation.; see also reviews PMID 21804597: Transient receptor potential channels as therapeutic targets and PMID 15194117: TRP ion channels in the nervous system. |
| 312 | TSHZ2 | intronic | 128553 | teashirt zinc finger homeobox 2; AD link (PMID 19343227): FE65 binds Teashirt, inhibiting expression of the primate-specific caspase-4 [APP binds FE65] | teashirt zinc finger homeobox 2; AD link (PMID 19343227): FE65 binds Teashirt, inhibiting expression of the primate-specific caspase-4 [APP binds FE65] |
| 313 | TSPYL6 | exonic | 388951 | No gene information | No gene information |
| 314 | UBE2D3 | exonic | 7323 | PD link, see PMID 20051513: Lysine 63-linked polyubiquitination of the dopamine transporter requires WW3 and WW4 domains of Nedd4-2 and UBE2D ubiquitin-conjugating enzymes | PD link, see PMID 20051513: Lysine 63-linked polyubiquitination of the dopamine transporter requires WW3 and WW4 domains of Nedd4-2 and UBE2D ubiquitin-conjugating enzymes |
| 315 | ULK1 | exonic | 8408 | PMID 11146101 (mouse homolog): Interaction of the Unc-51-like kinase and microtubule-associated protein light chain 3 related proteins in the brain: possible role of vesicular transport in axonal elongation and PMID 15014512: Role of Unc51.1 and its binding partners in CNS axon outgrowth, in this review, 2 binding partners of ULK1 are cited (SYNGAP1 and SDCBP), and via AceView, link to LRRK2: http://www.ncbi.nlm.nih.gov/IEB/Research/Acembly/av.cgi?db=human&term=syngap1&submit=Go | PMID 11146101 (mouse homolog): Interaction of the Unc-51-like kinase and microtubule-associated protein light chain 3 related proteins in the brain: possible role of vesicular transport in axonal elongation and PMID 15014512: Role of Unc51.1 and its binding partners in CNS axon outgrowth, in this review, 2 binding partners of ULK1 are cited (SYNGAP1 and SDCBP), and via AceView, link to LRRK2: http://www.ncbi.nlm.nih.gov/IEB/Research/Acembly/av.cgi?db=human&term=syngap1&submit=Go |
| 316 | USP14 | exonic | 9097 | Link to PD and AD, from RefSeq description: "Mice with a mutation that results in reduced | Link to PD and AD, from RefSeq description: "Mice with a mutation that results in reduced expression of the ortholog of this |

TABLE 3-continued

| Gene ID # | RefSeq Gene Symbol | CNV Gene Region | NCBI Gene ID | Gene Biology Curation | Gene Annotation |
|---|---|---|---|---|---|
| | | | | expression of the ortholog of this protein are retarded for growth, develop severe tremors by 2 to 3 weeks of age followed by hindlimb paralysis and death by 6 to 10 weeks of age"; see also PMID 19726649: The proteasome-associated deubiquitinating enzyme Usp14 is essential for the maintenance of synaptic ubiquitin levels and the development of neuromuscular junctions | protein are retarded for growth, develop severe tremors by 2 to 3 weeks of age followed by hindlimb paralysis and death by 6 to 10 weeks of age"; see also PMID 19726649: The proteasome-associated deubiquitinating enzyme Usp14 is essential for the maintenance of synaptic ubiquitin levels and the development of neuromuscular junctions |
| 317 | VGLL4 | both | 9686 | vestigial like 4 (Drosophila) (protein: transcription cofactor vestigial-like protein 4; PMID 15140898), gene information limited but linked to PD via its role in VEGFA expression (PMID 20702774); in 1 PD case, CNV also impacts all of C3orf31 (gene product is MMP37-like protein mitochondrial precursor) | vestigial like 4 (Drosophila) (protein: transcription cofactor vestigial-like protein 4; PMID 15140898), gene information limited but linked to PD via its role in VEGFA expression (PMID 20702774); in 1 PD case, CNV also impacts all of C3orf31 (gene product is MMP37-like protein mitochondrial precursor) |
| 318 | VIMP | exonic | 55829 | Selenoprotein with PD link, PMIDs 21456042, 20880505, and 19146923, which is linked to DJ-1: Post-transcriptional regulation of mRNA associated with DJ-1 in sporadic Parkinson disease; AND SELS interacts with ATXN3, which is linked to PARK2, see PMID 20940148: The Machado-Joseph disease-associated mutant form of ataxin-3 regulates parkin ubiquitination and stability. | Selenoprotein with PD link, PMIDs 21456042, 20880505, and 19146923, which is linked to DJ-1: Post-transcriptional regulation of mRNA associated with DJ-1 in sporadic Parkinson disease; AND SELS interacts with ATXN3, which is linked to PARK2, see PMID 20940148: The Machado-Joseph disease-associated mutant form of ataxin-3 regulates parkin ubiquitination and stability. |
| 319 | VPREB1 | exonic | 7441 | pre-B lymphocyte 1; linked to RA (PMID 21144590) | pre-B lymphocyte 1; linked to RA (PMID 21144590) |
| 320 | WBSCR17 | intronic | 64409 | Williams Syndrome gene; for gene function see PMID 15744064: Cloning and expression of a brain-specific putative UDP-GalNAc: polypeptide N-acetylgalactosaminyltransferase gene | Williams Syndrome gene; for gene function see PMID 15744064: Cloning and expression of a brain-specific putative UDP-GalNAc: polypeptide N-acetylgalactosaminyltransferase gene |
| 321 | WDR11 | exonic | 55717 | Limited gene information; cancer (OMIM 606417) | Limited gene information; cancer (OMIM 606417) |
| 322 | WLS | intronic | 79971 | wntless homolog (Drosophila), OMIM 611514 Via Aceview, InterPro annotation: "Members of this family comprise various XK-related proteins, that are involved in sodium-dependent transport of neutral amino acids or oligopeptides. These proteins are responsible for the Kx blood group system - defects results in McLeod syndrome [MIM: 314850], an X-linked multi-system disorder characterised by late onset abnormalities in the neuromuscular and hematopoietic systems." | wntless homolog (Drosophila), OMIM 611514 Via Aceview, InterPro annotation: "Members of this family comprise various XK-related proteins, that are involved in sodium-dependent transport of neutral amino acids or oligopeptides. These proteins are responsible for the Kx blood group system - defects results in McLeod syndrome [MIM: 314850], an X-linked multi-system disorder characterised by late onset abnormalities in the neuromuscular and hematopoietic systems." |
| 323 | XKR4 | intronic | 114786 | | |
| 324 | XPOT | exonic | 11260 | This gene encodes a protein belonging to the RAN-GTPase exportin family that mediates export of tRNA from the nucleus to the cytoplasm. Translocation of tRNA to the cytoplasm occurs once exportin has bound both tRNA and GTP-bound RAN. | This gene encodes a protein belonging to the RAN-GTPase exportin family that mediates export of tRNA from the nucleus to the cytoplasm. Translocation of tRNA to the cytoplasm occurs once exportin has bound both tRNA and GTP-bound RAN. |

TABLE 3-continued

| Gene ID # | RefSeq Gene Symbol | CNV Gene Region | NCBI Gene ID | Gene Biology Curation | Gene Annotation |
|---|---|---|---|---|---|
| 325 | ZBTB20 | exonic | 26137 | Neurological links, such as PMIDs 17301088: Hippocampus-like corticoneurogenesis induced by two isoforms of the BTB-zinc finger gene Zbtb20 in mice; PMID 19955470: Zbtb20-induced CA1 pyramidal neuron development and area enlargement in the cerebral midline cortex of mice | Neurological links, such as PMIDs 17301088: Hippocampus-like corticoneurogenesis induced by two isoforms of the BTB-zinc finger gene Zbtb20 in mice; PMID 19955470: Zbtb20-induced CA1 pyramidal neuron development and area enlargement in the cerebral midline cortex of mice |
| 326 | ZC3H6 | intronic | 376940 | zinc finger CCCH-type containing 6, limited gene information | zinc finger CCCH-type containing 6, limited gene information |
| 327 | ZFHX3 | exonic | 463 | Gene alias is ATBF1; neurological links (PMID 20876357, 16251211) and PD links (PMIDs 7908247, 7881757, 15837137); associated with atrial fibrillation (PMID 19597492, 19597491 are GWAS); also many cancer refs; PMID 20876357: The ZFHX3 (ATBF1) transcription factor induces PDGFRB, which activates ATM in the cytoplasm to protect cerebellar neurons from oxidative stress; and role for family member PDGF-CC, PMID 20231377: Survival effect of PDGF-CC rescues neurons from apoptosis in both brain and retina by regulating GSK3beta phosphorylation | Gene alias is ATBF1; neurological links (PMID 20876357, 16251211) and PD links (PMIDs 7908247, 7881757, 15837137); associated with atrial fibrillation (PMID 19597492, 19597491 are GWAS); also many cancer refs; PMID 20876357: The ZFHX3 (ATBF1) transcription factor induces PDGFRB, which activates ATM in the cytoplasm to protect cerebellar neurons from oxidative stress; and role for family member PDGF-CC, PMID 20231377: Survival effect of PDGF-CC rescues neurons from apoptosis in both brain and retina by regulating GSK3beta phosphorylation |
| 328 | ZNF280A | exonic | 129025 | zinc finger protein 280A | This gene was predicted both by automated computational analysis and by similarity to a *Drosophila* gene and to predicted genes in other species (sheep, chimp, dog, cow). The predicted protein of this gene is similar to *Drosophila* suppressor of hairy wing protein, a leucine zipper protein which represses the function of transcriptional enhancers of the gypsy retrotransposon. [provided by RefSeq, July 2008]. ##RefSeq-Attributes-START## Transcript_exon_combination_evidence :: BC053901.1, BG473553.1 [ECO: 0000332] ##RefSeq-Attributes-END## |
| 329 | ZNF280B | exonic | 140883 | zinc finger protein 280B | This gene was identified by homology to other species. Its encoded protein is approximately 78-88% identical to a predicted sheep protein of unknown function. The protein is also approximately 25% identical to the *Drosophila* protein suppressor of hairy wing, which is a leucine zipper protein that represses the function of transcriptional enhancers of the gypsy retrotransposon. [provided by RefSeq, July 2008]. Sequence Note: This RefSeq record was created from transcript and genomic sequence data because no single transcript was available for the full length of the gene. The extent of this transcript is supported by transcript alignments. ##RefSeq-Attributes-START## Transcript_exon_combination_evidence :: AK097608.1, BQ219363.1 [ECO: 0000332] ##RefSeq-Attributes-END## |
| 330 | ZNF317 | exonic | 57693 | zinc finger protein 317, limited gene information | zinc finger protein 317, limited gene information |
| 331 | ZNF396 | both | 252884 | Limited gene information; see PMID 12801647 | Limited gene information; see PMID 12801647 |
| 332 | ZNF585B | intronic | 92285 | zinc finger protein 585B, no gene information | zinc finger protein 585B, no gene information |
| 333 | ZNF624 | intronic | 57547 | zinc finger protein 624; limited gene information | zinc finger protein 624; limited gene information |
| 334 | ZNF658 | exonic | 26149 | zinc finger protein 658 | No gene information |
| 335 | ZNF658B | exonic | 401509 | No gene information | zinc finger protein 658B, pseudogene (ZNF658B) |

TABLE 3-continued

| Gene ID # | RefSeq Gene Symbol | CNV Gene Region | NCBI Gene ID | Gene Biology Curation | Gene Annotation |
|---|---|---|---|---|---|
| 336 | ZNF707 | exonic | 286075 | zinc finger protein 707; limited gene information | zinc finger protein 707; limited gene information |
| 337 | ZNHIT1 | exonic | 10467 | No gene information | No gene information |

TABLE 4

| RefSeq Gene Symbol | CNV Gene Region | SEQ ID | RefSeq Accession Number | RefSeq Gene Description/Definition |
|---|---|---|---|---|
| ATRNL1 | intronic | SEQ ID 383 | NM_207303 | *Homo sapiens* attractin-like 1 (ATRNL1), mRNA. |
| CNTNAP2 | intronic | SEQ ID 384 | NM_014141 | *Homo sapiens* contactin associated protein-like 2 (CNTNAP2), mRNA. |
| MIR548T | intronic | SEQ ID 385 | NR_036093 | *Homo sapiens* microRNA 548t (MIR548T), microRNA. |
| ZC3H6 | intronic | SEQ ID 386 | NM_198581 | *Homo sapiens* zinc finger CCCH-type containing 6 (ZC3H6), mRNA. |
| DCC | intronic | SEQ ID 387 | NM_005215 | *Homo sapiens* deleted in colorectal carcinoma (DCC), mRNA. |
| C20orf26 | both | SEQ ID 388 | NM_001167816 | *Homo sapiens* chromosome 20 open reading frame 26 (C20orf26), transcript variant 2, mRNA. |
| C20orf26 | both | SEQ ID 389 | NM_015585 | *Homo sapiens* chromosome 20 open reading frame 26 (C20orf26), transcript variant 1, mRNA. |
| CRNKL1 | both | SEQ ID 390 | NM_016652 | *Homo sapiens* crooked neck pre-mRNA splicing factor-like 1 (*Drosophila*) (CRNKL1), mRNA. |
| FGF12 | intronic | SEQ ID 391 | NM_021032 | *Homo sapiens* fibroblast growth factor 12 (FGF12), transcript variant 1, mRNA. |
| FGF12 | intronic | SEQ ID 392 | NM_004113 | *Homo sapiens* fibroblast growth factor 12 (FGF12), transcript variant 2, mRNA. |
| FGF10 | exonic | SEQ ID 393 | NM_004465 | *Homo sapiens* fibroblast growth factor 10 (FGF10), mRNA. |
| LRRIQ3 | both | SEQ ID 394 | NM_001105659 | *Homo sapiens* leucine-rich repeats and IQ motif containing 3 (LRRIQ3), mRNA. |
| SENP5 | both | SEQ ID 395 | NM_152699 | *Homo sapiens* SUMO1/sentrin specific peptidase 5 (SENP5), mRNA. |
| PAK2 | exonic | SEQ ID 396 | NM_002577 | *Homo sapiens* p21 protein (Cdc42/Rac)-activated kinase 2 (PAK2), mRNA. |
| GADL1 | both | SEQ ID 397 | NM_207359 | *Homo sapiens* glutamate decarboxylase-like 1 (GADL1), mRNA. |
| MGAT4C | intronic | SEQ ID 398 | NM_013244 | *Homo sapiens* mannosyl (alpha-1,3-)-glycoprotein beta-1,4-N-acetylglucosaminyltransferase, isozyme C (putative) (MGAT4C), mRNA. |
| PLCL1 | both | SEQ ID 399 | NM_006226 | *Homo sapiens* phospholipase C-like 1 (PLCL1), mRNA. |
| MTHFD1L | both | SEQ ID 400 | NM_001242767 | *Homo sapiens* methylenetetrahydrofolate dehydrogenase (NADP+ dependent) 1-like (MTHFD1L), nuclear gene encoding mitochondrial protein, transcript variant 1, mRNA. |
| MTHFD1L | both | SEQ ID 401 | NM_015440 | *Homo sapiens* methylenetetrahydrofolate dehydrogenase (NADP+ dependent) 1-like (MTHFD1L), nuclear gene encoding mitochondrial protein, transcript variant 2, mRNA. |
| MTHFD1L | both | SEQ ID 402 | NM_001242768 | *Homo sapiens* methylenetetrahydrofolate dehydrogenase (NADP+ dependent) 1-like (MTHFD1L), transcript variant 3, mRNA. |
| RNF144B | both | SEQ ID 403 | NM_182757 | *Homo sapiens* ring finger protein 144B (RNF144B), mRNA. |
| FLJ33630 | intronic | SEQ ID 404 | NR_015360 | *Homo sapiens* uncharacterized LOC644873 (FLJ33630), non-coding RNA. |
| DPP6 | intronic | SEQ ID 405 | NM_001936 | *Homo sapiens* dipeptidyl-peptidase 6 (DPP6), transcript variant 2, mRNA. |
| DPP6 | intronic | SEQ ID 406 | NM_001039350 | *Homo sapiens* dipeptidyl-peptidase 6 (DPP6), transcript variant 3, mRNA. |
| DPP6 | intronic | SEQ ID 407 | NM_130797 | *Homo sapiens* dipeptidyl-peptidase 6 (DPP6), transcript variant 1, mRNA. |
| LRP1 | exonic | SEQ ID 408 | NM_002332 | *Homo sapiens* low density lipoprotein receptor-related protein 1 (LRP1), mRNA. |
| SHMT2 | exonic | SEQ ID 409 | NM_005412 | *Homo sapiens* serine hydroxymethyltransferase 2 (mitochondrial) (SHMT2), nuclear gene encoding mitochondrial protein, transcript variant 1, mRNA. |
| NDUFA4L2 | exonic | SEQ ID 410 | NM_020142 | *Homo sapiens* NADH dehydrogenase (ubiquinone) 1 alpha subcomplex, 4-like 2 (NDUFA4L2), mRNA. |
| SHMT2 | exonic | SEQ ID 411 | NR_029416 | *Homo sapiens* serine hydroxymethyltransferase 2 (mitochondrial) (SHMT2), transcript variant 7, non-coding RNA. |
| SHMT2 | exonic | SEQ ID 412 | NR_029415 | *Homo sapiens* serine hydroxymethyltransferase 2 (mitochondrial) (SHMT2), transcript variant 6, non-coding RNA. |
| SHMT2 | exonic | SEQ ID 413 | NM_001166358 | *Homo sapiens* serine hydroxymethyltransferase 2 (mitochondrial) (SHMT2), transcript variant 4, mRNA. |
| SHMT2 | exonic | SEQ ID 414 | NM_001166357 | *Homo sapiens* serine hydroxymethyltransferase 2 (mitochondrial) (SHMT2), transcript variant 3, mRNA. |
| SHMT2 | exonic | SEQ ID 415 | NM_001166356 | *Homo sapiens* serine hydroxymethyltransferase 2 (mitochondrial) (SHMT2), nuclear gene encoding mitochondrial protein, transcript variant 2, mRNA. |
| NXPH4 | exonic | SEQ ID 416 | NM_007224 | *Homo sapiens* neurexophilin 4 (NXPH4), mRNA. |
| SHMT2 | exonic | SEQ ID 417 | NM_001166359 | *Homo sapiens* serine hydroxymethyltransferase 2 (mitochondrial) (SHMT2), transcript variant 5, mRNA. |
| SHMT2 | exonic | SEQ ID 418 | NR_029417 | *Homo sapiens* serine hydroxymethyltransferase 2 (mitochondrial) (SHMT2), transcript variant 8, non-coding RNA. |
| ULK1 | exonic | SEQ ID 419 | NM_003565 | *Homo sapiens* unc-51-like kinase 1 (*C. elegans*) (ULK1), mRNA. |
| GSTTP2 | exonic | SEQ ID 420 | NR_003082 | *Homo sapiens* glutathione S-transferase theta pseudogene 2 (GSTTP2), non-coding RNA. |
| NLRP4 | exonic | SEQ ID 421 | NM_134444 | *Homo sapiens* NLR family, pyrin domain containing 4 (NLRP4), mRNA. |
| NLRP7 | exonic | SEQ ID 422 | NM_139176 | *Homo sapiens* NLR family, pyrin domain containing 7 (NLRP7), transcript variant 1, mRNA. |
| NLRP7 | exonic | SEQ ID 423 | NM_206828 | *Homo sapiens* NLR family, pyrin domain containing 7 (NLRP7), transcript variant 2, mRNA. |
| NLRP7 | exonic | SEQ ID 424 | NM_001127255 | *Homo sapiens* NLR family, pyrin domain containing 7 (NLRP7), transcript variant 3, mRNA. |
| ALDH1A3 | exonic | SEQ ID 425 | NM_000693 | *Homo sapiens* aldehyde dehydrogenase 1 family, member A3 (ALDH1A3), mRNA. |
| RTTN | both | SEQ ID 426 | NM_173630 | *Homo sapiens* rotatin (RTTN), mRNA. |
| RBFOX1 | intronic | SEQ ID 427 | NM_001142333 | *Homo sapiens* RNA binding protein, fox-1 homolog (*C. elegans*) 1 (RBFOX1), transcript variant 5, mRNA. |
| RBFOX1 | intronic | SEQ ID 428 | NM_018723 | *Homo sapiens* RNA binding protein, fox-1 homolog (*C. elegans*) 1 (RBFOX1), transcript variant 4, mRNA. |
| RBFOX1 | intronic | SEQ ID 429 | NM_001142334 | *Homo sapiens* RNA binding protein, fox-1 homolog (*C. elegans*) 1 (RBFOX1), transcript variant 6, mRNA. |
| FBXO18 | both | SEQ ID 430 | NM_001258452 | *Homo sapiens* F-box protein, helicase, 18 (FBXO18), transcript variant 3, mRNA. |
| FBXO18 | both | SEQ ID 431 | NM_001258453 | *Homo sapiens* F-box protein, helicase, 18 (FBXO18), transcript variant 4, mRNA. |
| FBXO18 | both | SEQ ID 432 | NM_032807 | *Homo sapiens* F-box protein, helicase, 18 (FBXO18), transcript variant 1, mRNA. |

TABLE 4-continued

| RefSeq Gene Symbol | CNV Gene Region | SEQ ID | RefSeq Accession Number | RefSeq Gene Description/Definition |
|---|---|---|---|---|
| FBXO18 | both | SEQ ID 433 | NM_178150 | Homo sapiens F-box protein, helicase, 18 (FBXO18), transcript variant 2, mRNA. |
| FBXW11 | both | SEQ ID 434 | NM_012300 | Homo sapiens F-box and WD repeat domain containing 11 (FBXW11), transcript variant 3, mRNA. |
| FBXW11 | both | SEQ ID 435 | NM_033645 | Homo sapiens F-box and WD repeat domain containing 11 (FBXW11), transcript variant 1, mRNA. |
| FBXW11 | both | SEQ ID 436 | NM_033644 | Homo sapiens F-box and WD repeat domain containing 11 (FBXW11), transcript variant 2, mRNA. |
| ERC2 | exonic | SEQ ID 437 | NM_015576 | Homo sapiens ELKS/RAB6-interacting/CAST family member 2 (ERC2), mRNA. |
| GABRE | exonic | SEQ ID 438 | NM_004961 | Homo sapiens gamma-aminobutyric acid (GABA) A receptor, epsilon (GABRE), mRNA. |
| KIF7 | exonic | SEQ ID 439 | NM_198525 | Homo sapiens kinesin family member 7 (KIF7), mRNA. |
| JAG2 | exonic | SEQ ID 440 | NM_002226 | Homo sapiens jagged 2 (JAG2), transcript variant 1, mRNA. |
| JAG2 | exonic | SEQ ID 441 | NM_145159 | Homo sapiens jagged 2 (JAG2), transcript variant 2, mRNA. |
| SRGAP2 | exonic | SEQ ID 442 | NM_015326 | Homo sapiens SLIT-ROBO Rho GTPase activating protein 2 (SRGAP2), transcript variant 1, mRNA. |
| SRGAP2 | exonic | SEQ ID 443 | NM_001170637 | Homo sapiens SLIT-ROBO Rho GTPase activating protein 2 (SRGAP2), transcript variant 3, mRNA. |
| SRGAP2 | exonic | SEQ ID 444 | NM_001042758 | Homo sapiens SLIT-ROBO Rho GTPase activating protein 2 (SRGAP2), transcript variant 2, mRNA. |
| CTSE | exonic | SEQ ID 445 | NM_001910 | Homo sapiens cathepsin E (CTSE), transcript variant 1, mRNA. |
| CTSE | exonic | SEQ ID 446 | NM_148964 | Homo sapiens cathepsin E (CTSE), transcript variant 2, mRNA. |
| LMLN | exonic | SEQ ID 447 | NR_026786 | Homo sapiens leishmanolysin-like (metallopeptidase M8 family) (LMLN), transcript variant 3, non-coding RNA. |
| LMLN | exonic | SEQ ID 448 | NM_001136049 | Homo sapiens leishmanolysin-like (metallopeptidase M8 family) (LMLN), transcript variant 1, mRNA. |
| LMLN | exonic | SEQ ID 449 | NR_026787 | Homo sapiens leishmanolysin-like (metallopeptidase M8 family) (LMLN), transcript variant 4, non-coding RNA. |
| LMLN | exonic | SEQ ID 450 | NM_033029 | Homo sapiens leishmanolysin-like (metallopeptidase M8 family) (LMLN), transcript variant 2, mRNA. |
| LRCH3 | exonic | SEQ ID 451 | NM_032773 | Homo sapiens leucine-rich repeats and calponin homology (CH) domain containing 3 (LRCH3), mRNA. |
| RPL35A | exonic | SEQ ID 452 | NM_000996 | Homo sapiens ribosomal protein L35a (RPL35A), mRNA. |
| IQCG | exonic | SEQ ID 453 | NM_001134435 | Homo sapiens IQ motif containing G (IQCG), transcript variant 2, mRNA. |
| IQCG | exonic | SEQ ID 454 | NM_032263 | Homo sapiens IQ motif containing G (IQCG), transcript variant 1, mRNA. |
| UBE2D3 | exonic | SEQ ID 455 | NM_003340 | Homo sapiens ubiquitin-conjugating enzyme E2D 3 (UBE2D3), transcript variant 1, mRNA. |
| UBE2D3 | exonic | SEQ ID 456 | NM_181887 | Homo sapiens ubiquitin-conjugating enzyme E2D 3 (UBE2D3), transcript variant 3, mRNA. |
| UBE2D3 | exonic | SEQ ID 457 | NM_181893 | Homo sapiens ubiquitin-conjugating enzyme E2D 3 (UBE2D3), transcript variant 9, mRNA. |
| UBE2D3 | exonic | SEQ ID 458 | NM_181892 | Homo sapiens ubiquitin-conjugating enzyme E2D 3 (UBE2D3), transcript variant 8, mRNA. |
| UBE2D3 | exonic | SEQ ID 459 | NM_181891 | Homo sapiens ubiquitin-conjugating enzyme E2D 3 (UBE2D3), transcript variant 7, mRNA. |
| UBE2D3 | exonic | SEQ ID 460 | NM_181890 | Homo sapiens ubiquitin-conjugating enzyme E2D 3 (UBE2D3), transcript variant 6, mRNA. |
| UBE2D3 | exonic | SEQ ID 461 | NM_181888 | Homo sapiens ubiquitin-conjugating enzyme E2D 3 (UBE2D3), transcript variant 4, mRNA. |
| UBE2D3 | exonic | SEQ ID 462 | NM_181886 | Homo sapiens ubiquitin-conjugating enzyme E2D 3 (UBE2D3), transcript variant 2, mRNA. |
| UBE2D3 | exonic | SEQ ID 463 | NM_181889 | Homo sapiens ubiquitin-conjugating enzyme E2D 3 (UBE2D3), transcript variant 5, mRNA. |
| LGI1 | intronic | SEQ ID 464 | NM_005097 | Homo sapiens leucine-rich, glioma inactivated 1 (LGI1), mRNA. |
| ANKRD16 | exonic | SEQ ID 465 | NM_019046 | Homo sapiens ankyrin repeat domain 16 (ANKRD16), transcript variant 1, mRNA. |
| ANKRD16 | exonic | SEQ ID 466 | NM_001009941 | Homo sapiens ankyrin repeat domain 16 (ANKRD16), transcript variant 2, mRNA. |
| ANKRD16 | exonic | SEQ ID 467 | NM_001009943 | Homo sapiens ankyrin repeat domain 16 (ANKRD16), transcript variant 4, mRNA. |
| NRG1 | intronic | SEQ ID 468 | NM_013962 | Homo sapiens neuregulin 1 (NRG1), transcript variant GGF2, mRNA. |
| NRG1 | intronic | SEQ ID 469 | NM_001160008 | Homo sapiens neuregulin 1 (NRG1), transcript variant HRG-beta2b, mRNA. |
| NRG1 | intronic | SEQ ID 470 | NM_001160007 | Homo sapiens neuregulin 1 (NRG1), transcript variant HRG-gamma3, mRNA. |
| NRG1 | intronic | SEQ ID 471 | NM_001160005 | Homo sapiens neuregulin 1 (NRG1), transcript variant HRG-beta3b, mRNA. |
| NRG1 | intronic | SEQ ID 472 | NM_001160004 | Homo sapiens neuregulin 1 (NRG1), transcript variant ndf43b, mRNA. |
| NRG1 | intronic | SEQ ID 473 | NM_013964 | Homo sapiens neuregulin 1 (NRG1), transcript variant HRG-alpha, mRNA. |
| NRG1 | intronic | SEQ ID 474 | NM_004495 | Homo sapiens neuregulin 1 (NRG1), transcript variant HRG-gamma, mRNA. |
| NRG1 | intronic | SEQ ID 475 | NM_013956 | Homo sapiens neuregulin 1 (NRG1), transcript variant HRG-beta1, mRNA. |
| NRG1 | intronic | SEQ ID 476 | NM_001160002 | Homo sapiens neuregulin 1 (NRG1), transcript variant HRG-gamma2, mRNA. |
| NRG1 | intronic | SEQ ID 477 | NM_013960 | Homo sapiens neuregulin 1 (NRG1), transcript variant ndf43, mRNA. |
| NRG1 | intronic | SEQ ID 478 | NM_013958 | Homo sapiens neuregulin 1 (NRG1), transcript variant HRG-beta3, mRNA. |
| NRG1 | intronic | SEQ ID 479 | NM_013957 | Homo sapiens neuregulin 1 (NRG1), transcript variant HRG-beta2, mRNA. |
| NRG3 | intronic | SEQ ID 480 | NM_001165972 | Homo sapiens neuregulin 3 (NRG3), transcript variant 2, mRNA. |
| NRG3 | intronic | SEQ ID 481 | NM_001010848 | Homo sapiens neuregulin 3 (NRG3), transcript variant 1, mRNA. |
| NRG3 | intronic | SEQ ID 482 | NM_001165973 | Homo sapiens neuregulin 3 (NRG3), transcript variant 3, mRNA. |
| NTF3 | both | SEQ ID 483 | NM_001102654 | Homo sapiens neurotrophin 3 (NTF3), transcript variant 1, mRNA. |
| MANBA | exonic | SEQ ID 484 | NM_005908 | Homo sapiens mannosidase, beta A, lysosomal (MANBA), mRNA. |
| TACR3 | exonic | SEQ ID 485 | NM_001059 | Homo sapiens tachykinin receptor 3 (TACR3), mRNA. |
| SLC39A8 | exonic | SEQ ID 486 | NM_001135146 | Homo sapiens solute carrier family 39 (zinc transporter), member 8 (SLC39A8), transcript variant 2, mRNA. |

TABLE 4-continued

| RefSeq Gene Symbol | CNV Gene Region | SEQ ID | RefSeq Accession Number | RefSeq Gene Description/Definition |
|---|---|---|---|---|
| SLC39A8 | exonic | SEQ ID 487 | NM_001135147 | *Homo sapiens* solute carrier family 39 (zinc transporter), member 8 (SLC39A8), transcript variant 3, mRNA. |
| SLC39A8 | exonic | SEQ ID 488 | NM_001135148 | *Homo sapiens* solute carrier family 39 (zinc transporter), member 8 (SLC39A8), transcript variant 4, mRNA. |
| NFKB1 | exonic | SEQ ID 489 | NM_001165412 | *Homo sapiens* nuclear factor of kappa light polypeptide gene enhancer in B-cells 1 (NFKB1), transcript variant 2, mRNA. |
| NFKB1 | exonic | SEQ ID 490 | NM_003998 | *Homo sapiens* nuclear factor of kappa light polypeptide gene enhancer in B-cells 1 (NFKB1), transcript variant 1, mRNA. |
| SLC39A8 | exonic | SEQ ID 491 | NM_022154 | *Homo sapiens* solute carrier family 39 (zinc transporter), member 8 (SLC39A8), transcript variant 1, mRNA. |
| CENPE | exonic | SEQ ID 492 | NM_001813 | *Homo sapiens* centromere protein E, 312 kDa (CENPE), mRNA. |
| SLC9B2 | exonic | SEQ ID 493 | NM_178833 | *Homo sapiens* solute carrier family 9, subfamily B (NHA2, cation proton antiporter 2), member 2 (SLC9B2), nuclear gene encoding mitochondrial protein, mRNA. |
| SLC9B1 | exonic | SEQ ID 494 | NM_139173 | *Homo sapiens* solute carrier family 9, subfamily B (NHA1, cation proton antiporter 1), member 1 (SLC9B1), nuclear gene encoding mitochondrial protein, transcript variant 1, mRNA. |
| SLC9B1 | exonic | SEQ ID 495 | NM_001100874 | *Homo sapiens* solute carrier family 9, subfamily B (NHA1, cation proton antiporter 1), member 1 (SLC9B1), nuclear gene encoding mitochondrial protein, transcript variant 2, mRNA. |
| SLC9B1 | exonic | SEQ ID 496 | NR_047515 | *Homo sapiens* solute carrier family 9, subfamily B (NHA1, cation proton antiporter 1), member 1 (SLC9B1), transcript variant 4, non-coding RNA. |
| SLC9B1 | exonic | SEQ ID 497 | NR_047513 | *Homo sapiens* solute carrier family 9, subfamily B (NHA1, cation proton antiporter 1), member 1 (SLC9B1), transcript variant 3, non-coding RNA. |
| CISD2 | exonic | SEQ ID 498 | NM_001008388 | *Homo sapiens* CDGSH iron sulfur domain 2 (CISD2), mRNA. |
| BDH2 | exonic | SEQ ID 499 | NM_020139 | *Homo sapiens* 3-hydroxybutyrate dehydrogenase, type 2 (BDH2), mRNA. |
| MGAM | exonic | SEQ ID 500 | NM_004668 | *Homo sapiens* maltase-glucoamylase (alpha-glucosidase) (MGAM), mRNA. |
| PCDHA8 | exonic | SEQ ID 501 | NM_018911 | *Homo sapiens* protocadherin alpha 8 (PCDHA8), transcript variant 1, mRNA. |
| PCDHA6 | exonic | SEQ ID 502 | NM_018909 | *Homo sapiens* protocadherin alpha 6 (PCDHA6), transcript variant 1, mRNA. |
| PCDHA5 | exonic | SEQ ID 503 | NM_018908 | *Homo sapiens* protocadherin alpha 5 (PCDHA5), transcript variant 1, mRNA. |
| PCDHA9 | exonic | SEQ ID 504 | NM_031857 | *Homo sapiens* protocadherin alpha 9 (PCDHA9), transcript variant 1, mRNA. |
| PCDHA7 | exonic | SEQ ID 505 | NM_018910 | *Homo sapiens* protocadherin alpha 7 (PCDHA7), transcript variant 1, mRNA. |
| PCDHA3 | exonic | SEQ ID 506 | NM_018906 | *Homo sapiens* protocadherin alpha 3 (PCDHA3), transcript variant 1, mRNA. |
| PCDHA6 | exonic | SEQ ID 507 | NM_031849 | *Homo sapiens* protocadherin alpha 6 (PCDHA6), transcript variant 3, mRNA. |
| PCDHA2 | exonic | SEQ ID 508 | NM_018905 | *Homo sapiens* protocadherin alpha 2 (PCDHA2), transcript variant 1, mRNA. |
| PCDHA10 | exonic | SEQ ID 509 | NM_031860 | *Homo sapiens* protocadherin alpha 10 (PCDHA10), transcript variant 3, mRNA. |
| PCDHA1 | exonic | SEQ ID 510 | NM_031411 | *Homo sapiens* protocadherin alpha 1 (PCDHA1), transcript variant 3, mRNA. |
| PCDHA1 | exonic | SEQ ID 511 | NM_018900 | *Homo sapiens* protocadherin alpha 1 (PCDHA1), transcript variant 1, mRNA. |
| PCDHA4 | exonic | SEQ ID 512 | NM_018907 | *Homo sapiens* protocadherin alpha 4 (PCDHA4), transcript variant 1, mRNA. |
| PCDHA10 | exonic | SEQ ID 513 | NM_018901 | *Homo sapiens* protocadherin alpha 10 (PCDHA10), transcript variant 1, mRNA. |
| PCDHA9 | exonic | SEQ ID 514 | NM_014005 | *Homo sapiens* protocadherin alpha 9 (PCDHA9), transcript variant 2, mRNA. |
| PCDHA10 | exonic | SEQ ID 515 | NM_031859 | *Homo sapiens* protocadherin alpha 10 (PCDHA10), transcript variant 2, mRNA. |
| PCDHA8 | exonic | SEQ ID 516 | NM_031856 | *Homo sapiens* protocadherin alpha 8 (PCDHA8), transcript variant 2, mRNA. |
| PARVB | exonic | SEQ ID 517 | NM_013327 | *Homo sapiens* parvin, beta (PARVB), transcript variant 2, mRNA. |
| PARVB | exonic | SEQ ID 518 | NM_001243386 | *Homo sapiens* parvin, beta (PARVB), transcript variant 4, mRNA. |
| PARVB | exonic | SEQ ID 519 | NM_001243385 | *Homo sapiens* parvin, beta (PARVB), transcript variant 3, mRNA. |
| PARVB | exonic | SEQ ID 520 | NM_001003828 | *Homo sapiens* parvin, beta (PARVB), transcript variant 1, mRNA. |
| PTPRO | both | SEQ ID 521 | NM_002848 | *Homo sapiens* protein tyrosine phosphatase, receptor type, O (PTPRO), transcript variant 2, mRNA. |
| PTPRO | both | SEQ ID 522 | NM_030667 | *Homo sapiens* protein tyrosine phosphatase, receptor type, O (PTPRO), transcript variant 1, mRNA. |
| SLC25A24 | both | SEQ ID 523 | NM_013386 | *Homo sapiens* solute carrier family 25 (mitochondrial carrier; phosphate carrier), member 24 (SLC25A24), nuclear gene encoding mitochondrial protein, transcript variant 1, mRNA. |
| SLC25A24 | both | SEQ ID 524 | NM_213651 | *Homo sapiens* solute carrier family 25 (mitochondrial carrier; phosphate carrier), member 24 (SLC25A24), nuclear gene encoding mitochondrial protein, transcript variant 2, mRNA. |
| SLC38A6 | both | SEQ ID 525 | NR_033344 | *Homo sapiens* solute carrier family 38, member 6 (SLC38A6), transcript variant 3, non-coding RNA. |
| SLC38A6 | both | SEQ ID 526 | NM_153811 | *Homo sapiens* solute carrier family 38, member 6 (SLC38A6), transcript variant 2, mRNA. |
| SLC38A6 | both | SEQ ID 527 | NM_001172702 | *Homo sapiens* solute carrier family 38, member 6 (SLC38A6), transcript variant 1, mRNA. |
| CORIN | exonic | SEQ ID 528 | NM_006587 | *Homo sapiens* corin, serine peptidase (CORIN), mRNA. |
| DDX11 | both | SEQ ID 529 | NM_152438 | *Homo sapiens* DEAD/H (Asp-Glu-Ala-Asp/His) box helicase 11 (DDX11), transcript variant 3, mRNA. |
| DDX11 | both | SEQ ID 530 | NM_004399 | *Homo sapiens* DEAD/H (Asp-Glu-Ala-Asp/His) box helicase 11 (DDX11), transcript variant 2, mRNA. |
| DDX11 | both | SEQ ID 531 | NM_030653 | *Homo sapiens* DEAD/H (Asp-Glu-Ala-Asp/His) box helicase 11 (DDX11), transcript variant 1, mRNA. |
| DDX11 | both | SEQ ID 532 | NM_001257144 | *Homo sapiens* DEAD/H (Asp-Glu-Ala-Asp/His) box helicase 11 (DDX11), transcript variant 4, mRNA. |
| DDX11 | both | SEQ ID 533 | NM_001257145 | *Homo sapiens* DEAD/H (Asp-Glu-Ala-Asp/His) box helicase 11 (DDX11), transcript variant 5, mRNA. |
| DDX11-AS1 | exonic | SEQ ID 534 | NR_038927 | *Homo sapiens* DDX11 antisense RNA 1 (DDX11-AS1), non-coding RNA. |
| CFH | exonic | SEQ ID 535 | NM_000186 | *Homo sapiens* complement factor H (CFH), nuclear gene encoding mitochondrial protein, transcript variant 1, mRNA. |

TABLE 4-continued

| RefSeq Gene Symbol | CNV Gene Region | SEQ ID | RefSeq Accession Number | RefSeq Gene Description/Definition |
|---|---|---|---|---|
| CFHR3 | exonic | SEQ ID 536 | NM_001166624 | *Homo sapiens* complement factor H-related 3 (CFHR3), transcript variant 2, mRNA. |
| CFHR3 | exonic | SEQ ID 537 | NM_021023 | *Homo sapiens* complement factor H-related 3 (CFHR3), transcript variant 1, mRNA. |
| CFHR1 | exonic | SEQ ID 538 | NM_002113 | *Homo sapiens* complement factor H-related 1 (CFHR1), mRNA. |
| CFHR4 | exonic | SEQ ID 539 | NM_001201551 | *Homo sapiens* complement factor H-related 4 (CFHR4), transcript variant 2, mRNA. |
| CFHR4 | exonic | SEQ ID 540 | NM_006684 | *Homo sapiens* complement factor H-related 4 (CFHR4), transcript variant 3, mRNA. |
| CFHR4 | exonic | SEQ ID 541 | NM_001201550 | *Homo sapiens* complement factor H-related 4 (CFHR4), transcript variant 1, mRNA. |
| KATNAL2 | exonic | SEQ ID 542 | NM_031303 | *Homo sapiens* katanin p60 subunit A-like 2 (KATNAL2), mRNA. |
| KCNA7 | exonic | SEQ ID 543 | NM_031886 | *Homo sapiens* potassium voltage-gated channel, shaker-related subfamily, member 7 (KCNA7), mRNA. |
| NTF4 | exonic | SEQ ID 544 | NM_006179 | *Homo sapiens* neurotrophin 4 (NTF4), mRNA. |
| LOC255130 | both | SEQ ID 545 | NR_034081 | *Homo sapiens* uncharacterized LOC255130 (LOC255130), non-coding RNA. |
| MLL3 | both | SEQ ID 546 | NM_170606 | *Homo sapiens* myeloid/lymphoid or mixed-lineage leukemia 3 (MLL3), mRNA. |
| FABP5P3 | exonic | SEQ ID 547 | NR_002935 | *Homo sapiens* fatty acid binding protein 5 pseudogene 3 (FABP5P3), non-coding RNA. |
| LOC100128822 | exonic | SEQ ID 548 | NR_027387 | *Homo sapiens* uncharacterized LOC100128822 (LOC100128822), non-coding RNA. |
| ZNF396 | both | SEQ ID 549 | NM_145756 | *Homo sapiens* zinc finger protein 396 (ZNF396), mRNA. |
| PITPNM3 | exonic | SEQ ID 550 | NM_031220 | *Homo sapiens* PITPNM family member 3 (PITPNM3), transcript variant 1, mRNA. |
| PITPNM3 | exonic | SEQ ID 551 | NM_001165966 | *Homo sapiens* PITPNM family member 3 (PITPNM3), transcript variant 2, mRNA. |
| PITPNC1 | intronic | SEQ ID 552 | NM_012417 | *Homo sapiens* phosphatidylinositol transfer protein, cytoplasmic 1 (PITPNC1), transcript variant 1, mRNA. |
| PITPNC1 | intronic | SEQ ID 553 | NM_181671 | *Homo sapiens* phosphatidylinositol transfer protein, cytoplasmic 1 (PITPNC1), transcript variant 2, mRNA. |
| ACTG1P4 | exonic | SEQ ID 554 | NR_024438 | *Homo sapiens* actin, gamma 1 pseudogene 4 (ACTG1P4), non-coding RNA. |
| AMY2B | both | SEQ ID 555 | NM_020978 | *Homo sapiens* amylase, alpha 2B (pancreatic) (AMY2B), mRNA. |
| AMY1A | exonic | SEQ ID 556 | NM_004038 | *Homo sapiens* amylase, alpha 1A (salivary) (AMY1A), transcript variant 1, mRNA. |
| AMY1A | exonic | SEQ ID 557 | NM_001008221 | *Homo sapiens* amylase, alpha 1A (salivary) (AMY1A), transcript variant 2, mRNA. |
| AMY2A | exonic | SEQ ID 558 | NM_000699 | *Homo sapiens* amylase, alpha 2A (pancreatic) (AMY2A), mRNA. |
| AMY1C | exonic | SEQ ID 559 | NM_001008219 | *Homo sapiens* amylase, alpha 1C (salivary) (AMY1C), mRNA. |
| AMY1B | exonic | SEQ ID 560 | NM_001008218 | *Homo sapiens* amylase, alpha 1B (salivary) (AMY1B), mRNA. |
| RNPC3 | exonic | SEQ ID 561 | NM_017619 | *Homo sapiens* RNA-binding region (RNP1, RRM) containing 3 (RNPC3), mRNA. |
| MEGF10 | both | SEQ ID 562 | NM_032446 | *Homo sapiens* multiple EGF-like-domains 10 (MEGF10), transcript variant 1, mRNA. |
| MEGF10 | both | SEQ ID 563 | NM_001256545 | *Homo sapiens* multiple EGF-like-domains 10 (MEGF10), transcript variant 2, mRNA. |
| ZNF317 | exonic | SEQ ID 564 | NM_020933 | *Homo sapiens* zinc finger protein 317 (ZNF317), transcript variant 1, mRNA. |
| ZNF317 | exonic | SEQ ID 565 | NM_001190791 | *Homo sapiens* zinc finger protein 317 (ZNF317), transcript variant 1, mRNA. |
| TRIQK | both | SEQ ID 566 | NM_001171798 | *Homo sapiens* triple QxxK/R motif containing (TRIQK), transcript variant 4, mRNA. |
| TRIQK | both | SEQ ID 567 | NM_001171795 | *Homo sapiens* triple QxxK/R motif containing (TRIQK), transcript variant 3, mRNA. |
| TRIQK | both | SEQ ID 568 | NM_001191036 | *Homo sapiens* triple QxxK/R motif containing (TRIQK), transcript variant 7, mRNA. |
| TRIQK | both | SEQ ID 569 | NM_001171796 | *Homo sapiens* triple QxxK/R motif containing (TRIQK), transcript variant 1, mRNA. |
| TRIQK | both | SEQ ID 570 | NM_001171797 | *Homo sapiens* triple QxxK/R motif containing (TRIQK), transcript variant 2, mRNA. |
| TRIQK | both | SEQ ID 571 | NM_001191035 | *Homo sapiens* triple QxxK/R motif containing (TRIQK), transcript variant 6, mRNA. |
| TRIQK | both | SEQ ID 572 | NM_001171799 | *Homo sapiens* triple QxxK/R motif containing (TRIQK), transcript variant 5, mRNA. |
| CERK | exonic | SEQ ID 573 | NM_022766 | *Homo sapiens* ceramide kinase (CERK), mRNA. |
| CTSL2 | exonic | SEQ ID 574 | NM_001201575 | *Homo sapiens* cathepsin L2 (CTSL2), transcript variant 2, mRNA. |
| CTSL2 | exonic | SEQ ID 575 | NM_001333 | *Homo sapiens* cathepsin L2 (CTSL2), transcript variant 1, mRNA. |
| FAM35A | exonic | SEQ ID 576 | NM_019054 | *Homo sapiens* family with sequence similarity 35, member A (FAM35A), mRNA. |
| LOC728190 | exonic | SEQ ID 577 | NR_024397 | *Homo sapiens* uncharacterized LOC728190 (LOC728190), non-coding RNA. |
| FAM22A | exonic | SEQ ID 578 | NM_001099338 | *Homo sapiens* family with sequence similarity 22, member A (FAM22A), mRNA. |
| LOC439994 | exonic | SEQ ID 579 | NR_029408 | *Homo sapiens* uncharacterized LOC439994 (LOC439994), non-coding RNA. |
| FAM22D | exonic | SEQ ID 580 | NM_001009610 | *Homo sapiens* family with sequence similarity 22, member D (FAM22D), mRNA. |
| LOC728218 | exonic | SEQ ID 581 | NR_046091 | *Homo sapiens* uncharacterized LOC728218 (LOC728218), non-coding RNA. |
| MAS1 | exonic | SEQ ID 582 | NM_002377 | *Homo sapiens* MAS1 oncogene (MAS1), mRNA. |
| METTL21C | both | SEQ ID 583 | NM_001010977 | *Homo sapiens* methyltransferase like 21C (METTL21C), mRNA. |
| MNX1 | exonic | SEQ ID 584 | NM_001165255 | *Homo sapiens* motor neuron and pancreas homeobox 1 (MNX1), transcript variant 2, mRNA. |
| MNX1 | exonic | SEQ ID 585 | NM_005515 | *Homo sapiens* motor neuron and pancreas homeobox 1 (MNX1), transcript variant 1, mRNA. |
| NSL1 | exonic | SEQ ID 586 | NM_001042549 | *Homo sapiens* NSL1, MIND kinetochore complex component, homolog (*S. cerevisiae*) (NSL1), transcript variant 2, mRNA. |
| NSL1 | exonic | SEQ ID 587 | NM_015471 | *Homo sapiens* NSL1, MIND kinetochore complex component, homolog (*S. cerevisiae*) (NSL1), transcript variant 1, mRNA. |
| PIGZ | exonic | SEQ ID 588 | NM_025163 | *Homo sapiens* phosphatidylinositol glycan anchor biosynthesis, class Z (PIGZ), mRNA. |
| PKD1L3 | exonic | SEQ ID 589 | NM_181536 | *Homo sapiens* polycystic kidney disease 1-like 3 (PKD1L3), mRNA. |
| PROSC | exonic | SEQ ID 590 | NM_007198 | *Homo sapiens* proline synthetase co-transcribed homolog (bacterial) (PROSC), mRNA. |
| RALYL | both | SEQ ID 591 | NM_173848 | *Homo sapiens* RALY RNA binding protein-like (RALYL), transcript variant 3, mRNA. |
| RALYL | both | SEQ ID 592 | NM_001100393 | *Homo sapiens* RALY RNA binding protein-like (RALYL), transcript variant 4, mRNA. |
| RALYL | both | SEQ ID 593 | NM_001100392 | *Homo sapiens* RALY RNA binding protein-like (RALYL), transcript variant 2, mRNA. |
| RALYL | both | SEQ ID 594 | NM_001100391 | *Homo sapiens* RALY RNA binding protein-like (RALYL), transcript variant 1, mRNA. |
| RASA3 | exonic | SEQ ID 595 | NM_007368 | *Homo sapiens* RAS p21 protein activator 3 (RASA3), mRNA. |
| RBM27 | both | SEQ ID 596 | NM_018989 | *Homo sapiens* RNA binding motif protein 27 (RBM27), mRNA. |
| RBM25 | intronic | SEQ ID 597 | NM_021239 | *Homo sapiens* RNA binding motif protein 25 (RBM25), mRNA. |
| TARS | exonic | SEQ ID 598 | NM_001258438 | *Homo sapiens* threonyl-tRNA synthetase (TARS), transcript variant 3, mRNA. |

TABLE 4-continued

| RefSeq Gene Symbol | CNV Gene Region | SEQ ID | RefSeq Accession Number | RefSeq Gene Description/Definition |
|---|---|---|---|---|
| TARS | exonic | SEQ ID 599 | NM_152295 | *Homo sapiens* threonyl-tRNA synthetase (TARS), transcript variant 1, mRNA. |
| TARS | exonic | SEQ ID 600 | NR_047676 | *Homo sapiens* threonyl-tRNA synthetase (TARS), transcript variant 4, non-coding RNA. |
| TARS | exonic | SEQ ID 601 | NR_047677 | *Homo sapiens* threonyl-tRNA synthetase (TARS), transcript variant 5, non-coding RNA. |
| TARS | exonic | SEQ ID 602 | NR_047678 | *Homo sapiens* threonyl-tRNA synthetase (TARS), transcript variant 6, non-coding RNA. |
| TARS | exonic | SEQ ID 603 | NM_001258437 | *Homo sapiens* threonyl-tRNA synthetase (TARS), transcript variant 2, mRNA. |
| TAAR1 | exonic | SEQ ID 604 | NM_138327 | *Homo sapiens* trace amine associated receptor 1 (TAAR1), mRNA. |
| TPTE2P3 | exonic | SEQ ID 605 | NR_002793 | *Homo sapiens* transmembrane phosphoinositide 3-phosphatase and tensin homolog 2 pseudogene 3 (TPTE2P3), non-coding RNA. |
| TRAF3 | exonic | SEQ ID 606 | NM_001199427 | *Homo sapiens* TNF receptor-associated factor 3 (TRAF3), transcript variant 4, mRNA. |
| TRAF3 | exonic | SEQ ID 607 | NM_003300 | *Homo sapiens* TNF receptor-associated factor 3 (TRAF3), transcript variant 3, mRNA. |
| TRAF3 | exonic | SEQ ID 608 | NM_145726 | *Homo sapiens* TNF receptor-associated factor 3 (TRAF3), transcript variant 2, mRNA. |
| TRAF3 | exonic | SEQ ID 609 | NM_145725 | *Homo sapiens* TNF receptor-associated factor 3 (TRAF3), transcript variant 1, mRNA. |
| ZBTB20 | exonic | SEQ ID 610 | NM_001164345 | *Homo sapiens* zinc finger and BTB domain containing 20 (ZBTB20), transcript variant 5, mRNA. |
| ZBTB20 | exonic | SEQ ID 611 | NM_001164344 | *Homo sapiens* zinc finger and BTB domain containing 20 (ZBTB20), transcript variant 4, mRNA. |
| ZBTB20 | exonic | SEQ ID 612 | NM_015642 | *Homo sapiens* zinc finger and BTB domain containing 20 (ZBTB20), transcript variant 2, mRNA. |
| ZBTB20 | exonic | SEQ ID 613 | NM_001164343 | *Homo sapiens* zinc finger and BTB domain containing 20 (ZBTB20), transcript variant 3, mRNA. |
| FAM70B | both | SEQ ID 614 | NM_182614 | *Homo sapiens* family with sequence similarity 70, member B (FAM70B), mRNA. |
| GAS6 | exonic | SEQ ID 615 | NM_001143946 | *Homo sapiens* growth arrest-specific 6 (GAS6), transcript variant 3, mRNA. |
| GAS6 | exonic | SEQ ID 616 | NM_000820 | *Homo sapiens* growth arrest-specific 6 (GAS6), transcript variant 1, mRNA. |
| GAS6-AS1 | exonic | SEQ ID 617 | NR_044995 | *Homo sapiens* GAS6 antisense RNA 1 (GAS6-AS1), non-coding RNA. |
| GAS6 | exonic | SEQ ID 618 | NM_001143945 | *Homo sapiens* growth arrest-specific 6 (GAS6), transcript variant 2, mRNA. |
| ACYP2 | both | SEQ ID 619 | NM_138448 | *Homo sapiens* acylphosphatase 2, muscle type (ACYP2), mRNA. |
| TSPYL6 | exonic | SEQ ID 620 | NM_001003937 | *Homo sapiens* TSPY-like 6 (TSPYL6), mRNA. |
| AKR1B15 | exonic | SEQ ID 621 | NM_001080538 | *Homo sapiens* aldo-keto reductase family 1, member B15 (AKR1B15), mRNA. |
| ATP12A | exonic | SEQ ID 622 | NM_001185085 | *Homo sapiens* ATPase, H+/K+ transporting, nongastric, alpha polypeptide (ATP12A), transcript variant 1, mRNA. |
| ATP12A | exonic | SEQ ID 623 | NM_001676 | *Homo sapiens* ATPase, H+/K+ transporting, nongastric, alpha polypeptide (ATP12A), transcript variant 2, mRNA. |
| BLVRA | exonic | SEQ ID 624 | NM_000712 | *Homo sapiens* biliverdin reductase A (BLVRA), transcript variant 1, mRNA. |
| BLVRA | exonic | SEQ ID 625 | NM_001253823 | *Homo sapiens* biliverdin reductase A (BLVRA), transcript variant 2, mRNA. |
| C16orf74 | exonic | SEQ ID 626 | NM_206967 | *Homo sapiens* chromosome 16 open reading frame 74 (C16orf74), mRNA. |
| MIR1910 | exonic | SEQ ID 627 | NR_031731 | *Homo sapiens* microRNA 1910 (MIR1910), microRNA. |
| VGLL4 | both | SEQ ID 628 | NM_014667 | *Homo sapiens* vestigial like 4 (*Drosophila*) (VGLL4), transcript variant 2, mRNA. |
| TAMM41 | exonic | SEQ ID 629 | NM_138807 | *Homo sapiens* TAM41, mitochondrial translocator assembly and maintenance protein, homolog (*S. cerevisiae*) (TAMM41), nuclear gene encoding mitochondrial protein, mRNA. |
| COL24A1 | exonic | SEQ ID 630 | NM_152890 | *Homo sapiens* collagen, type XXIV, alpha 1 (COL24A1), mRNA. |
| DCTN4 | both | SEQ ID 631 | NM_001135643 | *Homo sapiens* dynactin 4 (p62) (DCTN4), transcript variant 1, mRNA. |
| DCTN4 | both | SEQ ID 632 | NM_001135644 | *Homo sapiens* dynactin 4 (p62) (DCTN4), transcript variant 3, mRNA. |
| DCTN4 | both | SEQ ID 633 | NM_016221 | *Homo sapiens* dynactin 4 (p62) (DCTN4), transcript variant 2, mRNA. |
| DGKB | both | SEQ ID 634 | NM_145695 | *Homo sapiens* diacylglycerol kinase, beta 90 kDa (DGKB), transcript variant 2, mRNA. |
| DGKB | both | SEQ ID 635 | NM_004080 | *Homo sapiens* diacylglycerol kinase, beta 90 kDa (DGKB), transcript variant 1, mRNA. |
| DLG2 | both | SEQ ID 636 | NM_001142699 | *Homo sapiens* discs, large homolog 2 (*Drosophila*) (DLG2), transcript variant 1, mRNA. |
| F7 | exonic | SEQ ID 637 | NM_001267554 | *Homo sapiens* coagulation factor VII (serum prothrombin conversion accelerator) (F7), transcript variant 3, mRNA. |
| F7 | exonic | SEQ ID 638 | NM_019616 | *Homo sapiens* coagulation factor VII (serum prothrombin conversion accelerator) (F7), transcript variant 2, mRNA. |
| F7 | exonic | SEQ ID 639 | NM_000131 | *Homo sapiens* coagulation factor VII (serum prothrombin conversion accelerator) (F7), transcript variant 1, mRNA. |
| F7 | exonic | SEQ ID 640 | NR_051961 | *Homo sapiens* coagulation factor VII (serum prothrombin conversion accelerator) (F7), transcript variant 4, non-coding RNA. |
| MGC21881 | exonic | SEQ ID 641 | NR_015363 | *Homo sapiens* uncharacterized locus MGC21881 (MGC21881), non-coding RNA. |
| LOC653501 | exonic | SEQ ID 642 | NR_003528 | *Homo sapiens* zinc finger protein 658 pseudogene (LOC653501), non-coding RNA. |
| CNTNAP3 | exonic | SEQ ID 643 | NM_033655 | *Homo sapiens* contactin associated protein-like 3 (CNTNAP3), mRNA. |
| ZNF658 | exonic | SEQ ID 644 | NM_033160 | *Homo sapiens* zinc finger protein 658 (ZNF658), mRNA. |
| AQP7P3 | exonic | SEQ ID 645 | NR_026558 | *Homo sapiens* aquaporin 7 pseudogene 3 (AQP7P3), non-coding RNA. |
| ANKRD20A2 | exonic | SEQ ID 646 | NM_001012421 | *Homo sapiens* ankyrin repeat domain 20 family, member A2 (ANKRD20A2), mRNA. |
| ANKRD20A3 | exonic | SEQ ID 647 | NM_001012419 | *Homo sapiens* ankyrin repeat domain 20 family, member A3 (ANKRD20A3), mRNA. |
| ZNF658B | exonic | SEQ ID 648 | NR_027861 | *Homo sapiens* zinc finger protein 658B, pseudogene (ZNF658B), non-coding RNA. |
| SPATA31A1 | exonic | SEQ ID 649 | NM_001085452 | *Homo sapiens* SPATA31 subfamily A, member 1 (SPATA31A1), mRNA. |
| SPATA31A2 | exonic | SEQ ID 650 | NM_001040065 | *Homo sapiens* SPATA31 subfamily A, member 2 (SPATA31A2), mRNA. |
| FAM74A1 | exonic | SEQ ID 651 | NR_026803 | *Homo sapiens* family with sequence similarity 74, member A1 (FAM74A1), non-coding RNA. |
| SPATA31A3 | exonic | SEQ ID 652 | NM_001083124 | *Homo sapiens* SPATA31 subfamily A, member 3 (SPATA31A3), mRNA. |
| FAM74A3 | exonic | SEQ ID 653 | NR_026801 | *Homo sapiens* family with sequence similarity 74, member A3 (FAM74A3), non-coding RNA. |

TABLE 4-continued

| RefSeq Gene Symbol | CNV Gene Region | SEQ ID | RefSeq Accession Number | RefSeq Gene Description/Definition |
|---|---|---|---|---|
| SPATA31A5 | exonic | SEQ ID 654 | NM_001113541 | *Homo sapiens* SPATA31 subfamily A, member 5 (SPATA31A5), mRNA. |
| SPATA31A7 | exonic | SEQ ID 655 | NM_015667 | *Homo sapiens* SPATA31 subfamily A, member 7 (SPATA31A7), mRNA. |
| SPATA31A4 | exonic | SEQ ID 656 | NM_001242613 | *Homo sapiens* SPATA31 subfamily A, member 4 (SPATA31A4), mRNA. |
| KGFLP2 | exonic | SEQ ID 657 | NR_003670 | *Homo sapiens* keratinocyte growth factor-like protein 2 (KGFLP2), non-coding RNA. |
| LOC643648 | exonic | SEQ ID 658 | NR_046203 | *Homo sapiens* uncharacterized LOC643648 (LOC643648), non-coding RNA. |
| FAM95B1 | exonic | SEQ ID 659 | NR_026759 | *Homo sapiens* family with sequence similarity 95, member B1 (FAM95B1), non-coding RNA. |
| FOXD4L4 | exonic | SEQ ID 660 | NM_199244 | *Homo sapiens* forkhead box D4-like 4 (FOXD4L4), mRNA. |
| FOXD4L2 | exonic | SEQ ID 661 | NM_001099279 | *Homo sapiens* forkhead box D4-like 2 (FOXD4L2), mRNA. |
| LOC286297 | exonic | SEQ ID 662 | NR_046175 | *Homo sapiens* uncharacterized LOC286297 (LOC286297), non-coding RNA. |
| LOC642929 | exonic | SEQ ID 663 | NR_027472 | *Homo sapiens* general transcription factor II, i pseudogene (LOC642929), non-coding RNA. |
| SPATA31A6 | exonic | SEQ ID 664 | NM_001145196 | *Homo sapiens* SPATA31 subfamily A, member 6 (SPATA31A6), mRNA. |
| CNTNAP3B | exonic | SEQ ID 665 | NM_001201380 | *Homo sapiens* contactin associated protein-like 3B (CNTNAP3B), mRNA. |
| FAM27C | exonic | SEQ ID 666 | NR_027421 | *Homo sapiens* family with sequence similarity 27, member C (FAM27C), non-coding RNA. |
| IL1RAPL1 | both | SEQ ID 667 | NM_014271 | *Homo sapiens* interleukin 1 receptor accessory protein-like 1 (IL1RAPL1), mRNA. |
| IL1RAPL2 | intronic | SEQ ID 668 | NM_017416 | *Homo sapiens* interleukin 1 receptor accessory protein-like 2 (IL1RAPL2), mRNA. |
| GNB1 | exonic | SEQ ID 669 | NM_002074 | *Homo sapiens* guanine nucleotide binding protein (G protein), beta polypeptide 1 (GNB1), mRNA. |
| KIAA1751 | exonic | SEQ ID 670 | NM_001080484 | *Homo sapiens* KIAA1751 (KIAA1751), mRNA. |
| TMEM52 | exonic | SEQ ID 671 | NM_178545 | *Homo sapiens* transmembrane protein 52 (TMEM52), mRNA. |
| CALML6 | exonic | SEQ ID 672 | NM_138705 | *Homo sapiens* calmodulin-like 6 (CALML6), mRNA. |
| KLRC2 | exonic | SEQ ID 673 | NM_002260 | *Homo sapiens* killer cell lectin-like receptor subfamily C, member 2 (KLRC2), mRNA. |
| KLRC1 | exonic | SEQ ID 674 | NM_002259 | *Homo sapiens* killer cell lectin-like receptor subfamily C, member 1 (KLRC1), transcript variant 1, mRNA. |
| KLRC1 | exonic | SEQ ID 675 | NM_213658 | *Homo sapiens* killer cell lectin-like receptor subfamily C, member 1 (KLRC1), transcript variant 3, mRNA. |
| KLRC1 | exonic | SEQ ID 676 | NM_213657 | *Homo sapiens* killer cell lectin-like receptor subfamily C, member 1 (KLRC1), transcript variant 4, mRNA. |
| KLRC1 | exonic | SEQ ID 677 | NM_007328 | *Homo sapiens* killer cell lectin-like receptor subfamily C, member 1 (KLRC1), transcript variant 2, mRNA. |
| KLRC3 | exonic | SEQ ID 678 | NM_002261 | *Homo sapiens* killer cell lectin-like receptor subfamily C, member 3 (KLRC3), transcript variant 1, mRNA. |
| KLRC3 | exonic | SEQ ID 679 | NM_007333 | *Homo sapiens* killer cell lectin-like receptor subfamily C, member 3 (KLRC3), transcript variant 2, mRNA. |
| ZNF707 | exonic | SEQ ID 680 | NM_001100599 | *Homo sapiens* zinc finger protein 707 (ZNF707), transcript variant 3, mRNA. |
| BREA2 | exonic | SEQ ID 681 | NR_015445 | *Homo sapiens* breast cancer estrogen-induced apoptosis 2 (BREA2), non-coding RNA. |
| ZNF707 | exonic | SEQ ID 682 | NM_001100598 | *Homo sapiens* zinc finger protein 707 (ZNF707), transcript variant 2, mRNA. |
| CCDC166 | exonic | SEQ ID 683 | NM_001162914 | *Homo sapiens* coiled-coil domain containing 166 (CCDC166), mRNA. |
| ZNF707 | exonic | SEQ ID 684 | NM_173831 | *Homo sapiens* zinc finger protein 707 (ZNF707), transcript variant 1, mRNA. |
| GRM5 | intronic | SEQ ID 685 | NM_000842 | *Homo sapiens* glutamate receptor, metabotropic 5 (GRM5), transcript variant b, mRNA. |
| GRM5 | intronic | SEQ ID 686 | NM_001143831 | *Homo sapiens* glutamate receptor, metabotropic 5 (GRM5), transcript variant a, mRNA. |
| KANSL1 | both | SEQ ID 687 | NM_015443 | *Homo sapiens* KAT8 regulatory NSL complex subunit 1 (KANSL1), transcript variant 2, mRNA. |
| KANSL1 | both | SEQ ID 688 | NM_001193466 | *Homo sapiens* KAT8 regulatory NSL complex subunit 1 (KANSL1), transcript variant 1, mRNA. |
| KANSL1 | both | SEQ ID 689 | NM_001193465 | *Homo sapiens* KAT8 regulatory NSL complex subunit 1 (KANSL1), transcript variant 3, mRNA. |
| KANSL1-AS1 | exonic | SEQ ID 690 | NR_034172 | *Homo sapiens* KANSL1 antisense RNA 1 (KANSL1-AS1), non-coding RNA. |
| ADK | intronic | SEQ ID 691 | NM_006721 | *Homo sapiens* adenosine kinase (ADK), transcript variant 2, mRNA. |
| ADK | intronic | SEQ ID 692 | NM_001123 | *Homo sapiens* adenosine kinase (ADK), transcript variant 1, mRNA. |
| ADK | intronic | SEQ ID 693 | NM_001202449 | *Homo sapiens* adenosine kinase (ADK), transcript variant 3, mRNA. |
| ADK | intronic | SEQ ID 694 | NM_001202450 | *Homo sapiens* adenosine kinase (ADK), transcript variant 4, mRNA. |
| BICC1 | both | SEQ ID 695 | NM_001080512 | *Homo sapiens* bicaudal C homolog 1 (*Drosophila*) (BICC1), mRNA. |
| FAM133CP | exonic | SEQ ID 696 | NR_027508 | *Homo sapiens* family with sequence similarity 133, member C, pseudogene (FAM133CP), non-coding RNA. |
| NLGN1 | intronic | SEQ ID 697 | NM_014932 | *Homo sapiens* neuroligin 1 (NLGN1), mRNA. |
| PRTN3 | exonic | SEQ ID 698 | NM_002777 | *Homo sapiens* proteinase 3 (PRTN3), mRNA. |
| MATN2 | intronic | SEQ ID 699 | NM_030583 | *Homo sapiens* matrilin 2 (MATN2), transcript variant 2, mRNA. |
| MATN2 | intronic | SEQ ID 700 | NM_002380 | *Homo sapiens* matrilin 2 (MATN2), transcript variant 1, mRNA. |
| SGK1 | exonic | SEQ ID 701 | NM_001143676 | *Homo sapiens* serum/glucocorticoid regulated kinase 1 (SGK1), transcript variant 2, mRNA. |
| ALLC | intronic | SEQ ID 702 | NM_018436 | *Homo sapiens* allantoicase (ALLC), transcript variant 1, mRNA. |
| PCBD2 | intronic | SEQ ID 703 | NM_032151 | *Homo sapiens* pterin-4 alpha-carbinolamine dehydratase/dimerization cofactor of hepatocyte nuclear factor 1 alpha (TCF1) 2 (PCBD2), mRNA. |
| SPAG16 | both | SEQ ID 704 | NM_024532 | *Homo sapiens* sperm associated antigen 16 (SPAG16), transcript variant 1, mRNA. |
| SPAG16 | both | SEQ ID 705 | NR_047659 | *Homo sapiens* sperm associated antigen 16 (SPAG16), transcript variant 3, non-coding RNA. |
| SPAG16 | both | SEQ ID 706 | NR_047660 | *Homo sapiens* sperm associated antigen 16 (SPAG16), transcript variant 4, non-coding RNA. |
| PUF60 | exonic | SEQ ID 707 | NM_014281 | *Homo sapiens* poly-U binding splicing factor 60 KDa (PUF60), transcript variant 2, mRNA. |

TABLE 4-continued

| RefSeq Gene Symbol | CNV Gene Region | SEQ ID | RefSeq Accession Number | RefSeq Gene Description/Definition |
|---|---|---|---|---|
| PUF60 | exonic | SEQ ID 708 | NM_001136033 | *Homo sapiens* poly-U binding splicing factor 60 KDa (PUF60), transcript variant 3, mRNA. |
| PUF60 | exonic | SEQ ID 709 | NM_078480 | *Homo sapiens* poly-U binding splicing factor 60 KDa (PUF60), transcript variant 1, mRNA. |
| PUF60 | exonic | SEQ ID 710 | NM_001271100 | *Homo sapiens* poly-U binding splicing factor 60 KDa (PUF60), transcript variant 8, mRNA. |
| PUF60 | exonic | SEQ ID 711 | NM_001271096 | *Homo sapiens* poly-U binding splicing factor 60 KDa (PUF60), transcript variant 4, mRNA. |
| PUF60 | exonic | SEQ ID 712 | NM_001271099 | *Homo sapiens* poly-U binding splicing factor 60 KDa (PUF60), transcript variant 7, mRNA. |
| PUF60 | exonic | SEQ ID 713 | NM_001271098 | *Homo sapiens* poly-U binding splicing factor 60 KDa (PUF60), transcript variant 6, mRNA. |
| PUF60 | exonic | SEQ ID 714 | NM_001271097 | *Homo sapiens* poly-U binding splicing factor 60 KDa (PUF60), transcript variant 5, mRNA. |
| STAU2 | both | SEQ ID 715 | NM_001164381 | *Homo sapiens* staufen, RNA binding protein, homolog 2 (*Drosophila*) (STAU2), transcript variant 2, mRNA. |
| STAU2 | both | SEQ ID 716 | NM_001164383 | *Homo sapiens* staufen, RNA binding protein, homolog 2 (*Drosophila*) (STAU2), transcript variant 4, mRNA. |
| STAU2 | both | SEQ ID 717 | NM_001164382 | *Homo sapiens* staufen, RNA binding protein, homolog 2 (*Drosophila*) (STAU2), transcript variant 3, mRNA. |
| STAU2 | both | SEQ ID 718 | NM_001164380 | *Homo sapiens* staufen, RNA binding protein, homolog 2 (*Drosophila*) (STAU2), transcript variant 1, mRNA. |
| STAU2 | both | SEQ ID 719 | NM_001164384 | *Homo sapiens* staufen, RNA binding protein, homolog 2 (*Drosophila*) (STAU2), transcript variant 6, mRNA. |
| STAU2 | both | SEQ ID 720 | NM_001164385 | *Homo sapiens* staufen, RNA binding protein, homolog 2 (*Drosophila*) (STAU2), transcript variant 7, mRNA. |
| STAU2 | both | SEQ ID 721 | NM_014393 | *Homo sapiens* staufen, RNA binding protein, homolog 2 (*Drosophila*) (STAU2), transcript variant 5, mRNA. |
| CNBD1 | intronic | SEQ ID 722 | NM_173538 | *Homo sapiens* cyclic nucleotide binding domain containing 1 (CNBD1), mRNA. |
| MIR5694 | exonic | SEQ ID 723 | NR_049879 | *Homo sapiens* microRNA 5694 (MIR5694), microRNA. |
| WDR11 | exonic | SEQ ID 724 | NM_018117 | *Homo sapiens* WD repeat domain 11 (WDR11), mRNA. |
| RNF130 | exonic | SEQ ID 725 | NM_018434 | *Homo sapiens* ring finger protein 130 (RNF130), mRNA. |
| VIMP | exonic | SEQ ID 726 | NM_203472 | *Homo sapiens* VCP-interacting membrane protein (VIMP), transcript variant 1, mRNA. |
| VIMP | exonic | SEQ ID 727 | NM_018445 | *Homo sapiens* VCP-interacting membrane protein (VIMP), transcript variant 2, mRNA. |
| HKR1 | intronic | SEQ ID 728 | NM_181786 | *Homo sapiens* HKR1, GLI-Kruppel zinc finger family member (HKR1), mRNA. |
| SEPT14 | exonic | SEQ ID 729 | NM_207366 | *Homo sapiens* septin 14 (SEPT14), mRNA. |
| STK31 | intronic | SEQ ID 730 | NM_001260505 | *Homo sapiens* serine/threonine kinase 31 (STK31), transcript variant 5, mRNA. |
| STK31 | intronic | SEQ ID 731 | NM_031414 | *Homo sapiens* serine/threonine kinase 31 (STK31), transcript variant 1, mRNA. |
| STK31 | intronic | SEQ ID 732 | NM_001260504 | *Homo sapiens* serine/threonine kinase 31 (STK31), transcript variant 4, mRNA. |
| STK31 | intronic | SEQ ID 733 | NM_032944 | *Homo sapiens* serine/threonine kinase 31 (STK31), transcript variant 2, mRNA. |
| STK31 | intronic | SEQ ID 734 | NR_048542 | *Homo sapiens* serine/threonine kinase 31 (STK31), transcript variant 3, non-coding RNA. |
| TSHZ2 | intronic | SEQ ID 735 | NM_173485 | *Homo sapiens* teashirt zinc finger homeobox 2 (TSHZ2), transcript variant 1, mRNA. |
| ZNF585B | intronic | SEQ ID 736 | NM_152279 | *Homo sapiens* zinc finger protein 585B (ZNF585B), mRNA. |
| BCOR | intronic | SEQ ID 737 | NM_001123384 | *Homo sapiens* BCL6 corepressor (BCOR), transcript variant 4, mRNA. |
| BCOR | intronic | SEQ ID 738 | NM_001123383 | *Homo sapiens* BCL6 corepressor (BCOR), transcript variant 3, mRNA. |
| CRB1 | intronic | SEQ ID 739 | NM_001193640 | *Homo sapiens* crumbs homolog 1 (*Drosophila*) (CRB1), transcript variant 2, mRNA. |
| CRB1 | intronic | SEQ ID 740 | NM_201253 | *Homo sapiens* crumbs homolog 1 (*Drosophila*) (CRB1), transcript variant 1, mRNA. |
| CRB1 | intronic | SEQ ID 741 | NM_001257965 | *Homo sapiens* crumbs homolog 1 (*Drosophila*) (CRB1), transcript variant 3, mRNA. |
| CRB1 | intronic | SEQ ID 742 | NM_001257966 | *Homo sapiens* crumbs homolog 1 (*Drosophila*) (CRB1), transcript variant 4, mRNA. |
| CRB1 | intronic | SEQ ID 743 | NR_047563 | *Homo sapiens* crumbs homolog 1 (*Drosophila*) (CRB1), transcript variant 5, non-coding RNA. |
| CRB1 | intronic | SEQ ID 744 | NR_047564 | *Homo sapiens* crumbs homolog 1 (*Drosophila*) (CRB1), transcript variant 6, non-coding RNA. |
| PLD1 | intronic | SEQ ID 745 | NM_002662 | *Homo sapiens* phospholipase D1, phosphatidylcholine-specific (PLD1), transcript variant 1, mRNA. |
| PLD1 | intronic | SEQ ID 746 | NM_001130081 | *Homo sapiens* phospholipase D1, phosphatidylcholine-specific (PLD1), transcript variant 2, mRNA. |
| PSD3 | intronic | SEQ ID 747 | NM_015310 | *Homo sapiens* pleckstrin and Sec7 domain containing 3 (PSD3), transcript variant 1, mRNA. |
| RGS6 | intronic | SEQ ID 748 | NM_001204418 | *Homo sapiens* regulator of G-protein signaling 6 (RGS6), transcript variant 4, mRNA. |
| RGS6 | intronic | SEQ ID 749 | NM_001204417 | *Homo sapiens* regulator of G-protein signaling 6 (RGS6), transcript variant 3, mRNA. |
| RGS6 | intronic | SEQ ID 750 | NM_001204416 | *Homo sapiens* regulator of G-protein signaling 6 (RGS6), transcript variant 1, mRNA. |
| RGS6 | intronic | SEQ ID 751 | NM_001204424 | *Homo sapiens* regulator of G-protein signaling 6 (RGS6), transcript variant 10, mRNA. |
| RGS6 | intronic | SEQ ID 752 | NM_004296 | *Homo sapiens* regulator of G-protein signaling 6 (RGS6), transcript variant 2, mRNA. |
| RGS6 | intronic | SEQ ID 753 | NM_001204421 | *Homo sapiens* regulator of G-protein signaling 6 (RGS6), transcript variant 7, mRNA. |
| RGS6 | intronic | SEQ ID 754 | NM_001204420 | *Homo sapiens* regulator of G-protein signaling 6 (RGS6), transcript variant 6, mRNA. |
| RGS6 | intronic | SEQ ID 755 | NM_001204423 | *Homo sapiens* regulator of G-protein signaling 6 (RGS6), transcript variant 9, mRNA. |
| RGS6 | intronic | SEQ ID 756 | NM_001204422 | *Homo sapiens* regulator of G-protein signaling 6 (RGS6), transcript variant 8, mRNA. |
| RGS6 | intronic | SEQ ID 757 | NM_001204419 | *Homo sapiens* regulator of G-protein signaling 6 (RGS6), transcript variant 5, mRNA. |
| RIMS1 | intronic | SEQ ID 758 | NM_014989 | *Homo sapiens* regulating synaptic membrane exocytosis 1 (RIMS1), transcript variant 1, mRNA. |
| ZNF624 | intronic | SEQ ID 759 | NM_020787 | *Homo sapiens* zinc finger protein 624 (ZNF624), mRNA. |

TABLE 4-continued

| RefSeq Gene Symbol | CNV Gene Region | SEQ ID | RefSeq Accession Number | RefSeq Gene Description/Definition |
|---|---|---|---|---|
| ADAMTS20 | intronic | SEQ ID 760 | NM_025003 | *Homo sapiens* ADAM metallopeptidase with thrombospondin type 1 motif, 20 (ADAMTS20), mRNA. |
| CAMTA1 | intronic | SEQ ID 761 | NM_015215 | *Homo sapiens* calmodulin binding transcription activator 1 (CAMTA1), transcript variant 1, mRNA. |
| CAMTA1 | intronic | SEQ ID 762 | NM_001195563 | *Homo sapiens* calmodulin binding transcription activator 1 (CAMTA1), transcript variant 2, mRNA. |
| CAMTA1 | intronic | SEQ ID 763 | NR_038934 | *Homo sapiens* calmodulin binding transcription activator 1 (CAMTA1), transcript variant 4, non-coding RNA. |
| CAMTA1 | intronic | SEQ ID 764 | NM_001242701 | *Homo sapiens* calmodulin binding transcription activator 1 (CAMTA1), transcript variant 3, mRNA. |
| CDH13 | intronic | SEQ ID 765 | NM_001257 | *Homo sapiens* cadherin 13, H-cadherin (heart) (CDH13), transcript variant 1, mRNA. |
| CDH13 | intronic | SEQ ID 766 | NM_001220490 | *Homo sapiens* cadherin 13, H-cadherin (heart) (CDH13), transcript variant 4, mRNA. |
| CDH13 | intronic | SEQ ID 767 | NM_001220489 | *Homo sapiens* cadherin 13, H-cadherin (heart) (CDH13), transcript variant 3, mRNA. |
| CDH13 | intronic | SEQ ID 768 | NM_001220488 | *Homo sapiens* cadherin 13, H-cadherin (heart) (CDH13), transcript variant 2, mRNA. |
| CDH13 | intronic | SEQ ID 769 | NM_001220492 | *Homo sapiens* cadherin 13, H-cadherin (heart) (CDH13), transcript variant 6, mRNA. |
| CDH13 | intronic | SEQ ID 770 | NM_001220491 | *Homo sapiens* cadherin 13, H-cadherin (heart) (CDH13), transcript variant 5, mRNA. |
| CRY1 | intronic | SEQ ID 771 | NM_004075 | *Homo sapiens* cryptochrome 1 (photolyase-like) (CRY1), mRNA. |
| CUX1 | intronic | SEQ ID 772 | NM_181500 | *Homo sapiens* cut-like homeobox 1 (CUX1), transcript variant 3, mRNA. |
| CUX1 | intronic | SEQ ID 773 | NM_001202545 | *Homo sapiens* cut-like homeobox 1 (CUX1), transcript variant 6, mRNA. |
| CUX1 | intronic | SEQ ID 774 | NM_001202544 | *Homo sapiens* cut-like homeobox 1 (CUX1), transcript variant 5, mRNA. |
| CUX1 | intronic | SEQ ID 775 | NM_001202546 | *Homo sapiens* cut-like homeobox 1 (CUX1), transcript variant 7, mRNA. |
| CUX1 | intronic | SEQ ID 776 | NM_001913 | *Homo sapiens* cut-like homeobox 1 (CUX1), transcript variant 2, mRNA. |
| CUX1 | intronic | SEQ ID 777 | NM_181552 | *Homo sapiens* cut-like homeobox 1 (CUX1), transcript variant 1, mRNA. |
| CUX1 | intronic | SEQ ID 778 | NM_001202543 | *Homo sapiens* cut-like homeobox 1 (CUX1), transcript variant 4, mRNA. |
| CYP4F12 | both | SEQ ID 779 | NM_023944 | *Homo sapiens* cytochrome P450, family 4, subfamily F, polypeptide 12 (CYP4F12), mRNA. |
| DLGAP2 | intronic | SEQ ID 780 | NM_004745 | *Homo sapiens* discs, large (*Drosophila*) homolog-associated protein 2 (DLGAP2), mRNA. |
| FMNL2 | intronic | SEQ ID 781 | NM_052905 | *Homo sapiens* formin-like 2 (FMNL2), mRNA. |
| GPR98 | intronic | SEQ ID 782 | NR_003149 | *Homo sapiens* G protein-coupled receptor 98 (GPR98), transcript variant 2, non-coding RNA. |
| GPR98 | intronic | SEQ ID 783 | NM_032119 | *Homo sapiens* G protein-coupled receptor 98 (GPR98), transcript variant 1, mRNA. |
| GRIN2A | intronic | SEQ ID 784 | NM_000833 | *Homo sapiens* glutamate receptor, ionotropic, N-methyl D-aspartate 2A (GRIN2A), transcript variant 2, mRNA. |
| GRIN2A | intronic | SEQ ID 785 | NM_001134408 | *Homo sapiens* glutamate receptor, ionotropic, N-methyl D-aspartate 2A (GRIN2A), transcript variant 3, mRNA. |
| GRIN2A | intronic | SEQ ID 786 | NM_001134407 | *Homo sapiens* glutamate receptor, ionotropic, N-methyl D-aspartate 2A (GRIN2A), transcript variant 1, mRNA. |
| MAGI3 | intronic | SEQ ID 787 | NM_001142782 | *Homo sapiens* membrane associated guanylate kinase, WW and PDZ domain containing 3 (MAGI3), transcript variant 1, mRNA. |
| MAGI3 | intronic | SEQ ID 788 | NM_152900 | *Homo sapiens* membrane associated guanylate kinase, WW and PDZ domain containing 3 (MAGI3), transcript variant 2, mRNA. |
| MAP2 | intronic | SEQ ID 789 | NM_001039538 | *Homo sapiens* microtubule-associated protein 2 (MAP2), transcript variant 5, mRNA. |
| MOB3B | intronic | SEQ ID 790 | NM_024761 | *Homo sapiens* MOB kinase activator 3B (MOB3B), mRNA. |
| NKAIN3 | intronic | SEQ ID 791 | NM_173688 | *Homo sapiens* Na+/K+ transporting ATPase interacting 3 (NKAIN3), mRNA. |
| NRXN3 | intronic | SEQ ID 792 | NM_004796 | *Homo sapiens* neurexin 3 (NRXN3), transcript variant 1, mRNA. |
| NRXN3 | intronic | SEQ ID 793 | NM_001105250 | *Homo sapiens* neurexin 3 (NRXN3), transcript variant 3, mRNA. |
| NRXN3 | intronic | SEQ ID 794 | NM_138970 | *Homo sapiens* neurexin 3 (NRXN3), transcript variant 2, mRNA. |
| PHACTR2 | intronic | SEQ ID 795 | NM_001100166 | *Homo sapiens* phosphatase and actin regulator 2 (PHACTR2), transcript variant 4, mRNA. |
| PHACTR2 | intronic | SEQ ID 796 | NM_014721 | *Homo sapiens* phosphatase and actin regulator 2 (PHACTR2), transcript variant 3, mRNA. |
| RASSF3 | intronic | SEQ ID 797 | NM_178169 | *Homo sapiens* Ras association (RalGDS/AF-6) domain family member 3 (RASSF3), transcript variant 1, mRNA. |
| RASSF3 | intronic | SEQ ID 798 | NR_040718 | *Homo sapiens* Ras association (RalGDS/AF-6) domain family member 3 (RASSF3), transcript variant 2, non-coding RNA. |
| RPS6KC1 | intronic | SEQ ID 799 | NM_001136138 | *Homo sapiens* ribosomal protein S6 kinase, 52 kDa, polypeptide 1 (RPS6KC1), transcript variant 2, mRNA. |
| RPS6KC1 | intronic | SEQ ID 800 | NM_012424 | *Homo sapiens* ribosomal protein S6 kinase, 52 kDa, polypeptide 1 (RPS6KC1), transcript variant 1, mRNA. |
| SPON1 | intronic | SEQ ID 801 | NM_006108 | *Homo sapiens* spondin 1, extracellular matrix protein (SPON1), mRNA. |
| STXBP5L | intronic | SEQ ID 802 | NM_014980 | *Homo sapiens* syntaxin binding protein 5-like (STXBP5L), mRNA. |
| STX8 | intronic | SEQ ID 803 | NR_033656 | *Homo sapiens* syntaxin 8 (STX8), transcript variant 2, non-coding RNA. |
| STX8 | intronic | SEQ ID 804 | NM_004853 | *Homo sapiens* syntaxin 8 (STX8), transcript variant 1, mRNA. |
| SYT1 | intronic | SEQ ID 805 | NM_001135805 | *Homo sapiens* synaptotagmin I (SYT1), transcript variant 2, mRNA. |
| SYT1 | intronic | SEQ ID 806 | NM_005639 | *Homo sapiens* synaptotagmin I (SYT1), transcript variant 1, mRNA. |
| TNFRSF1A | intronic | SEQ ID 807 | NM_001065 | *Homo sapiens* tumor necrosis factor receptor superfamily, member 1A (TNFRSF1A), mRNA. |
| ADAMTS3 | intronic | SEQ ID 808 | NM_014243 | *Homo sapiens* ADAM metallopeptidase with thrombospondin type 1 motif, 3 (ADAMTS3), mRNA. |
| BAIAP2L1 | intronic | SEQ ID 809 | NM_018842 | *Homo sapiens* BAI1-associated protein 2-like 1 (BAIAP2L1), mRNA. |
| C11orf49 | intronic | SEQ ID 810 | NM_024113 | *Homo sapiens* chromosome 11 open reading frame 49 (C11orf49), transcript variant 3, mRNA. |
| C11orf49 | intronic | SEQ ID 811 | NM_001003678 | *Homo sapiens* chromosome 11 open reading frame 49 (C11orf49), transcript variant 4, mRNA. |

TABLE 4-continued

| RefSeq Gene Symbol | CNV Gene Region | SEQ ID | RefSeq Accession Number | RefSeq Gene Description/Definition |
|---|---|---|---|---|
| C11orf49 | intronic | SEQ ID 812 | NM_001003677 | *Homo sapiens* chromosome 11 open reading frame 49 (C11orf49), transcript variant 2, mRNA. |
| C11orf49 | intronic | SEQ ID 813 | NM_001003676 | *Homo sapiens* chromosome 11 open reading frame 49 (C11orf49), transcript variant 1, mRNA. |
| CACNA2D1 | intronic | SEQ ID 814 | NM_000722 | *Homo sapiens* calcium channel, voltage-dependent, alpha 2/delta subunit 1 (CACNA2D1), mRNA. |
| CACNA1B | exonic | SEQ ID 815 | NM_001243812 | *Homo sapiens* calcium channel, voltage-dependent, N type, alpha 1B subunit (CACNA1B), transcript variant 2, mRNA. |
| CACNA1B | exonic | SEQ ID 816 | NM_000718 | *Homo sapiens* calcium channel, voltage-dependent, N type, alpha 1B subunit (CACNA1B), transcript variant 1, mRNA. |
| EFNA5 | intronic | SEQ ID 817 | NM_001962 | *Homo sapiens* ephrin-A5 (EFNA5), mRNA. |
| EPHA3 | exonic | SEQ ID 818 | NM_005233 | *Homo sapiens* EPH receptor A3 (EPHA3), transcript variant 1, mRNA. |
| EPHA3 | exonic | SEQ ID 819 | NM_182644 | *Homo sapiens* EPH receptor A3 (EPHA3), transcript variant 2, mRNA. |
| GALNT13 | intronic | SEQ ID 820 | NM_052917 | *Homo sapiens* UDP-N-acetyl-alpha-D-galactosamine:polypeptide N-acetylgalactosaminyltransferase 13 (GalNAc-T13) (GALNT13), mRNA. |
| IGSF21 | intronic | SEQ ID 821 | NM_032880 | *Homo sapiens* immunoglobin superfamily, member 21 (IGSF21), mRNA. |
| LRRFIP1 | intronic | SEQ ID 822 | NM_001137550 | *Homo sapiens* leucine rich repeat (in FLII) interacting protein 1 (LRRFIP1), transcript variant 1, mRNA. |
| MECP2 | intronic | SEQ ID 823 | NM_001110792 | *Homo sapiens* methyl CpG binding protein 2 (Rett syndrome) (MECP2), transcript variant 2, mRNA. |
| MECP2 | intronic | SEQ ID 824 | NM_004992 | *Homo sapiens* methyl CpG binding protein 2 (Rett syndrome) (MECP2), transcript variant 1, mRNA. |
| RGS7 | exonic | SEQ ID 825 | NM_002924 | *Homo sapiens* regulator of G-protein signaling 7 (RGS7), mRNA. |
| MIR3123 | exonic | SEQ ID 826 | NR_036069 | *Homo sapiens* microRNA 3123 (MIR3123), microRNA. |
| NFIC | intronic | SEQ ID 827 | NM_001245004 | *Homo sapiens* nuclear factor I/C (CCAAT-binding transcription factor) (NFIC), transcript variant 3, mRNA. |
| NFIC | intronic | SEQ ID 828 | NM_001245005 | *Homo sapiens* nuclear factor I/C (CCAAT-binding transcription factor) (NFIC), transcript variant 4, mRNA. |
| NFIC | intronic | SEQ ID 829 | NM_005597 | *Homo sapiens* nuclear factor I/C (CCAAT-binding transcription factor) (NFIC), transcript variant 5, mRNA. |
| NFIC | intronic | SEQ ID 830 | NM_205843 | *Homo sapiens* nuclear factor I/C (CCAAT-binding transcription factor) (NFIC), transcript variant 2, mRNA. |
| NFIC | intronic | SEQ ID 831 | NM_001245002 | *Homo sapiens* nuclear factor I/C (CCAAT-binding transcription factor) (NFIC), transcript variant 1, mRNA. |
| PTPRD | intronic | SEQ ID 832 | NM_001171025 | *Homo sapiens* protein tyrosine phosphatase, receptor type, D (PTPRD), transcript variant 6, mRNA. |
| PTPRD | intronic | SEQ ID 833 | NM_002839 | *Homo sapiens* protein tyrosine phosphatase, receptor type, D (PTPRD), transcript variant 1, mRNA. |
| PTPRD | intronic | SEQ ID 834 | NM_130393 | *Homo sapiens* protein tyrosine phosphatase, receptor type, D (PTPRD), transcript variant 4, mRNA. |
| PTPRD | intronic | SEQ ID 835 | NM_130392 | *Homo sapiens* protein tyrosine phosphatase, receptor type, D (PTPRD), transcript variant 3, mRNA. |
| PTPRD | intronic | SEQ ID 836 | NM_130391 | *Homo sapiens* protein tyrosine phosphatase, receptor type, D (PTPRD), transcript variant 2, mRNA. |
| PTPRD | intronic | SEQ ID 837 | NM_001040712 | *Homo sapiens* protein tyrosine phosphatase, receptor type, D (PTPRD), transcript variant 5, mRNA. |
| RORA | intronic | SEQ ID 838 | NM_134261 | *Homo sapiens* RAR-related orphan receptor A (RORA), transcript variant 1, mRNA. |
| SCAMP1 | intronic | SEQ ID 839 | NM_004866 | *Homo sapiens* secretory carrier membrane protein 1 (SCAMP1), mRNA. |
| TMEM117 | intronic | SEQ ID 840 | NM_032256 | *Homo sapiens* transmembrane protein 117 (TMEM117), mRNA. |
| WBSCR17 | intronic | SEQ ID 841 | NM_022479 | *Homo sapiens* Williams-Beuren syndrome chromosome region 17 (WBSCR17), mRNA. |
| GNG12-AS1 | intronic | SEQ ID 842 | NR_040077 | *Homo sapiens* GNG12 antisense RNA 1 (GNG12-AS1), non-coding RNA. |
| WLS | intronic | SEQ ID 843 | NM_001193334 | *Homo sapiens* wntless homolog (*Drosophila*) (WLS), transcript variant 3, mRNA. |
| WLS | intronic | SEQ ID 844 | NM_024911 | *Homo sapiens* wntless homolog (*Drosophila*) (WLS), transcript variant 1, mRNA. |
| WLS | intronic | SEQ ID 845 | NM_001002292 | *Homo sapiens* wntless homolog (*Drosophila*) (WLS), transcript variant 2, mRNA. |
| XKR4 | intronic | SEQ ID 846 | NM_052898 | *Homo sapiens* XK, Kell blood group complex subunit-related family, member 4 (XKR4), mRNA. |
| CREBRF | exonic | SEQ ID 847 | NM_153607 | *Homo sapiens* CREB3 regulatory factor (CREBRF), transcript variant 1, mRNA. |
| C4orf19 | exonic | SEQ ID 848 | NM_001104629 | *Homo sapiens* chromosome 4 open reading frame 19 (C4orf19), transcript variant 1, mRNA. |
| RELL1 | exonic | SEQ ID 849 | NM_001085399 | *Homo sapiens* RELT-like 1 (RELL1), transcript variant 2, mRNA. |
| C4orf19 | exonic | SEQ ID 850 | NM_018302 | *Homo sapiens* chromosome 4 open reading frame 19 (C4orf19), transcript variant 2, mRNA. |
| PREPL | exonic | SEQ ID 851 | NM_001042385 | *Homo sapiens* prolyl endopeptidase-like (PREPL), transcript variant 4, mRNA. |
| PREPL | exonic | SEQ ID 852 | NM_001171617 | *Homo sapiens* prolyl endopeptidase-like (PREPL), transcript variant 7, mRNA. |
| PREPL | exonic | SEQ ID 853 | NM_001042386 | *Homo sapiens* prolyl endopeptidase-like (PREPL), transcript variant 5, mRNA. |
| PREPL | exonic | SEQ ID 854 | NM_001171603 | *Homo sapiens* prolyl endopeptidase-like (PREPL), transcript variant 2, mRNA. |
| PREPL | exonic | SEQ ID 855 | NM_001171613 | *Homo sapiens* prolyl endopeptidase-like (PREPL), transcript variant 6, mRNA. |
| PREPL | exonic | SEQ ID 856 | NM_001171606 | *Homo sapiens* prolyl endopeptidase-like (PREPL), transcript variant 3, mRNA. |
| PREPL | exonic | SEQ ID 857 | NM_006036 | *Homo sapiens* prolyl endopeptidase-like (PREPL), transcript variant 1, mRNA. |
| CAMKMT | exonic | SEQ ID 858 | NM_024766 | *Homo sapiens* calmodulin-lysine N-methyltransferase (CAMKMT), mRNA. |
| SLC3A1 | exonic | SEQ ID 859 | NM_000341 | *Homo sapiens* solute carrier family 3 (cystine, dibasic and neutral amino acid transporters, activator of cystine, dibasic and neutral amino acid transport), member 1 (SLC3A1), mRNA. |
| DNAH10 | exonic | SEQ ID 860 | NM_207437 | *Homo sapiens* dynein, axonemal, heavy chain 10 (DNAH10), mRNA. |

TABLE 4-continued

| RefSeq Gene Symbol | CNV Gene Region | SEQ ID | RefSeq Accession Number | RefSeq Gene Description/Definition |
|---|---|---|---|---|
| DNAH12 | exonic | SEQ ID 861 | NM_178504 | *Homo sapiens* dynein, axonemal, heavy chain 12 (DNAH12), transcript variant 1, mRNA. |
| DNAH8 | exonic | SEQ ID 862 | NM_001206927 | *Homo sapiens* dynein, axonemal, heavy chain 8 (DNAH8), mRNA. |
| DNAJC18 | exonic | SEQ ID 863 | NM_152686 | *Homo sapiens* DnaJ (Hsp40) homolog, subfamily C, member 18 (DNAJC18), mRNA. |
| FHIT | exonic | SEQ ID 864 | NM_001166243 | *Homo sapiens* fragile histidine triad (FHIT), transcript variant 2, mRNA. |
| FHIT | exonic | SEQ ID 865 | NM_002012 | *Homo sapiens* fragile histidine triad (FHIT), transcript variant 1, mRNA. |
| LPP | exonic | SEQ ID 866 | NM_001167672 | *Homo sapiens* LIM domain containing preferred translocation partner in lipoma (LPP), transcript variant 3, mRNA. |
| LPP | exonic | SEQ ID 867 | NM_001167671 | *Homo sapiens* LIM domain containing preferred translocation partner in lipoma (LPP), transcript variant 2, mRNA. |
| LPP | exonic | SEQ ID 868 | NM_005578 | *Homo sapiens* LIM domain containing preferred translocation partner in lipoma (LPP), transcript variant 1, mRNA. |
| FLJ42393 | exonic | SEQ ID 869 | NR_024413 | *Homo sapiens* uncharacterized LOC401105 (FLJ42393), non-coding RNA. |
| LOC648691 | exonic | SEQ ID 870 | NR_027426 | *Homo sapiens* uncharacterized LOC648691 (LOC648691), non-coding RNA. |
| VPREB1 | exonic | SEQ ID 871 | NM_007128 | *Homo sapiens* pre-B lymphocyte 1 (VPREB1), mRNA. |
| LOC96610 | exonic | SEQ ID 872 | NR_027293 | *Homo sapiens* BMS1 homolog, ribosome assembly protein (yeast) pseudogene (LOC96610), non-coding RNA. |
| PRAME | exonic | SEQ ID 873 | NM_006115 | *Homo sapiens* preferentially expressed antigen in melanoma (PRAME), transcript variant 1, mRNA. |
| ZNF280A | exonic | SEQ ID 874 | NM_080740 | *Homo sapiens* zinc finger protein 280A (ZNF280A), mRNA. |
| ZNF280B | exonic | SEQ ID 875 | NM_080764 | *Homo sapiens* zinc finger protein 280B (ZNF280B), mRNA. |
| PRAME | exonic | SEQ ID 876 | NM_206956 | *Homo sapiens* preferentially expressed antigen in melanoma (PRAME), transcript variant 5, mRNA. |
| PRAME | exonic | SEQ ID 877 | NM_206955 | *Homo sapiens* preferentially expressed antigen in melanoma (PRAME), transcript variant 4, mRNA. |
| PRAME | exonic | SEQ ID 878 | NM_206954 | *Homo sapiens* preferentially expressed antigen in melanoma (PRAME), transcript variant 3, mRNA. |
| PRAME | exonic | SEQ ID 879 | NM_206953 | *Homo sapiens* preferentially expressed antigen in melanoma (PRAME), transcript variant 2, mRNA. |
| GGTLC2 | exonic | SEQ ID 880 | NM_199127 | *Homo sapiens* gamma-glutamyltransferase light chain 2 (GGTLC2), transcript variant 1, mRNA. |
| POM121L1P | exonic | SEQ ID 881 | NR_024591 | *Homo sapiens* POM121 transmembrane nucleoporin-like 1, pseudogene (POM121L1P), non-coding RNA. |
| MIR650 | exonic | SEQ ID 882 | NR_030755 | *Homo sapiens* microRNA 650 (MIR650), microRNA. |
| IGLL5 | exonic | SEQ ID 883 | NM_001178126 | *Homo sapiens* immunoglobulin lambda-like polypeptide 5 (IGLL5), transcript variant 1, mRNA. |
| IGLL5 | exonic | SEQ ID 884 | NM_001256296 | *Homo sapiens* immunoglobulin lambda-like polypeptide 5 (IGLL5), transcript variant 2, mRNA. |
| GNG4 | exonic | SEQ ID 885 | NM_004485 | *Homo sapiens* guanine nucleotide binding protein (G protein), gamma 4 (GNG4), transcript variant 3, mRNA. |
| GNG4 | exonic | SEQ ID 886 | NM_001098722 | *Homo sapiens* guanine nucleotide binding protein (G protein), gamma 4 (GNG4), transcript variant 1, mRNA. |
| GNG4 | exonic | SEQ ID 887 | NM_001098721 | *Homo sapiens* guanine nucleotide binding protein (G protein), gamma 4 (GNG4), transcript variant 2, mRNA. |
| B3GALNT2 | exonic | SEQ ID 888 | NM_152490 | *Homo sapiens* beta-1,3-N-acetylgalactosaminyltransferase 2 (B3GALNT2), mRNA. |
| TBCE | exonic | SEQ ID 889 | NM_003193 | *Homo sapiens* tubulin folding cofactor E (TBCE), transcript variant 2, mRNA. |
| TBCE | exonic | SEQ ID 890 | NM_001079515 | *Homo sapiens* tubulin folding cofactor E (TBCE), transcript variant 1, mRNA. |
| HTR1E | exonic | SEQ ID 891 | NM_000865 | *Homo sapiens* 5-hydroxytryptamine (serotonin) receptor 1E, G protein-coupled (HTR1E), mRNA. |
| IKBKB | exonic | SEQ ID 892 | NM_001190720 | *Homo sapiens* inhibitor of kappa light polypeptide gene enhancer in B-cells, kinase beta (IKBKB), transcript variant 2, mRNA. |
| IKBKB | exonic | SEQ ID 893 | NM_001242778 | *Homo sapiens* inhibitor of kappa light polypeptide gene enhancer in B-cells, kinase beta (IKBKB), transcript variant 7, mRNA. |
| IKBKB | exonic | SEQ ID 894 | NR_033819 | *Homo sapiens* inhibitor of kappa light polypeptide gene enhancer in B-cells, kinase beta (IKBKB), transcript variant 6, non-coding RNA. |
| IKBKB | exonic | SEQ ID 895 | NM_001556 | *Homo sapiens* inhibitor of kappa light polypeptide gene enhancer in B-cells, kinase beta (IKBKB), transcript variant 1, mRNA. |
| IKBKB | exonic | SEQ ID 896 | NR_040009 | *Homo sapiens* inhibitor of kappa light polypeptide gene enhancer in B-cells, kinase beta (IKBKB), transcript variant 8, non-coding RNA. |
| IKBKB | exonic | SEQ ID 897 | NR_033818 | *Homo sapiens* inhibitor of kappa light polypeptide gene enhancer in B-cells, kinase beta (IKBKB), transcript variant 5, non-coding RNA. |
| ITGAM | exonic | SEQ ID 898 | NM_001145808 | *Homo sapiens* integrin, alpha M (complement component 3 receptor 3 subunit) (ITGAM), transcript variant 1, mRNA. |
| ITGAM | exonic | SEQ ID 899 | NM_000632 | *Homo sapiens* integrin, alpha M (complement component 3 receptor 3 subunit) (ITGAM), transcript variant 2, mRNA. |
| KCNN3 | exonic | SEQ ID 900 | NM_170782 | *Homo sapiens* potassium intermediate/small conductance calcium-activated channel, subfamily N, member 3 (KCNN3), transcript variant 2, mRNA. |
| KCNN3 | exonic | SEQ ID 901 | NM_002249 | *Homo sapiens* potassium intermediate/small conductance calcium-activated channel, subfamily N, member 3 (KCNN3), transcript variant 1, mRNA. |
| KCNN3 | exonic | SEQ ID 902 | NM_001204087 | *Homo sapiens* potassium intermediate/small conductance calcium-activated channel, subfamily N, member 3 (KCNN3), transcript variant 3, mRNA. |
| KYNU | exonic | SEQ ID 903 | NM_003937 | *Homo sapiens* kynureninase (KYNU), transcript variant 1, mRNA. |
| KYNU | exonic | SEQ ID 904 | NM_001199241 | *Homo sapiens* kynureninase (KYNU), transcript variant 3, mRNA. |
| KYNU | exonic | SEQ ID 905 | NM_001032998 | *Homo sapiens* kynureninase (KYNU), transcript variant 2, mRNA. |
| KCNMA1 | exonic | SEQ ID 906 | NM_001161352 | *Homo sapiens* potassium large conductance calcium-activated channel, subfamily M, alpha member 1 (KCNMA1), transcript variant 3, mRNA. |

TABLE 4-continued

| RefSeq Gene Symbol | CNV Gene Region | SEQ ID | RefSeq Accession Number | RefSeq Gene Description/Definition |
|---|---|---|---|---|
| KCNMA1 | exonic | SEQ ID 907 | NM_001161353 | *Homo sapiens* potassium large conductance calcium-activated channel, subfamily M, alpha member 1 (KCNMA1), transcript variant 4, mRNA. |
| KCNMA1 | exonic | SEQ ID 908 | NM_002247 | *Homo sapiens* potassium large conductance calcium-activated channel, subfamily M, alpha member 1 (KCNMA1), transcript variant 2, mRNA. |
| KCNMA1 | exonic | SEQ ID 909 | NM_001014797 | *Homo sapiens* potassium large conductance calcium-activated channel, subfamily M, alpha member 1 (KCNMA1), transcript variant 1, mRNA. |
| KCNMA1 | exonic | SEQ ID 910 | NM_001271518 | *Homo sapiens* potassium large conductance calcium-activated channel, subfamily M, alpha member 1 (KCNMA1), transcript variant 5, mRNA. |
| KCNMA1 | exonic | SEQ ID 911 | NM_001271519 | *Homo sapiens* potassium large conductance calcium-activated channel, subfamily M, alpha member 1 (KCNMA1), transcript variant 6, mRNA. |
| DLG5 | exonic | SEQ ID 912 | NM_004747 | *Homo sapiens* discs, large homolog 5 (*Drosophila*) (DLG5), mRNA. |
| POLR3A | exonic | SEQ ID 913 | NM_007055 | *Homo sapiens* polymerase (RNA) III (DNA directed) polypeptide A, 155 kDa (POLR3A), mRNA. |
| KCNMA1 | exonic | SEQ ID 914 | NM_001271520 | *Homo sapiens* potassium large conductance calcium-activated channel, subfamily M, alpha member 1 (KCNMA1), transcript variant 7, mRNA. |
| KCNMA1 | exonic | SEQ ID 915 | NM_001271521 | *Homo sapiens* potassium large conductance calcium-activated channel, subfamily M, alpha member 1 (KCNMA1), transcript variant 8, mRNA. |
| KCNMA1 | exonic | SEQ ID 916 | NM_001271522 | *Homo sapiens* potassium large conductance calcium-activated channel, subfamily M, alpha member 1 (KCNMA1), transcript variant 9, mRNA. |
| LOC100128292 | exonic | SEQ ID 917 | NR_024585 | *Homo sapiens* uncharacterized LOC100128292 (LOC100128292), non-coding RNA. |
| RPS24 | exonic | SEQ ID 918 | NM_001142285 | *Homo sapiens* ribosomal protein S24 (RPS24), transcript variant d, mRNA. |
| RPS24 | exonic | SEQ ID 919 | NM_001142284 | *Homo sapiens* ribosomal protein S24 (RPS24), transcript variant b, mRNA. |
| RPS24 | exonic | SEQ ID 920 | NM_001142283 | *Homo sapiens* ribosomal protein S24 (RPS24), transcript variant e, mRNA. |
| RPS24 | exonic | SEQ ID 921 | NM_033022 | *Homo sapiens* ribosomal protein S24 (RPS24), transcript variant a, mRNA. |
| RPS24 | exonic | SEQ ID 922 | NM_001026 | *Homo sapiens* ribosomal protein S24 (RPS24), transcript variant c, mRNA. |
| RPS24 | exonic | SEQ ID 923 | NM_001142282 | *Homo sapiens* ribosomal protein S24 (RPS24), transcript variant f, mRNA. |
| GPR20 | exonic | SEQ ID 924 | NM_005293 | *Homo sapiens* G protein-coupled receptor 20 (GPR20), mRNA. |
| LOC731779 | exonic | SEQ ID 925 | NR_024441 | *Homo sapiens* uncharacterized LOC731779 (LOC731779), non-coding RNA. |
| PTP4A3 | exonic | SEQ ID 926 | NM_032611 | *Homo sapiens* protein tyrosine phosphatase type IVA, member 3 (PTP4A3), transcript variant 1, mRNA. |
| PTP4A3 | exonic | SEQ ID 927 | NM_007079 | *Homo sapiens* protein tyrosine phosphatase type IVA, member 3 (PTP4A3), transcript variant 2, mRNA. |
| LRP2 | exonic | SEQ ID 928 | NM_004525 | *Homo sapiens* low density lipoprotein receptor-related protein 2 (LRP2), mRNA. |
| LRRK2 | exonic | SEQ ID 929 | NM_198578 | *Homo sapiens* leucine-rich repeat kinase 2 (LRRK2), mRNA. |
| PCM1 | exonic | SEQ ID 930 | NM_006197 | *Homo sapiens* pericentriolar material 1 (PCM1), mRNA. |
| MTUS1 | exonic | SEQ ID 931 | NM_001001925 | *Homo sapiens* microtubule associated tumor suppressor 1 (MTUS1), transcript variant 2, mRNA. |
| MTUS1 | exonic | SEQ ID 932 | NM_001001924 | *Homo sapiens* microtubule associated tumor suppressor 1 (MTUS1), transcript variant 1, mRNA. |
| FGL1 | exonic | SEQ ID 933 | NM_004467 | *Homo sapiens* fibrinogen-like 1 (FGL1), transcript variant 1, mRNA. |
| FGL1 | exonic | SEQ ID 934 | NM_201553 | *Homo sapiens* fibrinogen-like 1 (FGL1), transcript variant 4, mRNA. |
| FGL1 | exonic | SEQ ID 935 | NM_201552 | *Homo sapiens* fibrinogen-like 1 (FGL1), transcript variant 3, mRNA. |
| FGL1 | exonic | SEQ ID 936 | NM_147203 | *Homo sapiens* fibrinogen-like 1 (FGL1), transcript variant 2, mRNA. |
| MYO3B | intronic | SEQ ID 937 | NR_045683 | *Homo sapiens* myosin IIIB (MYO3B), transcript variant 4, non-coding RNA. |
| MYO3B | intronic | SEQ ID 938 | NM_001083615 | *Homo sapiens* myosin IIIB (MYO3B), transcript variant 1, mRNA. |
| MYO3B | intronic | SEQ ID 939 | NR_045682 | *Homo sapiens* myosin IIIB (MYO3B), transcript variant 3, non-coding RNA. |
| MYO3B | intronic | SEQ ID 940 | NM_138995 | *Homo sapiens* myosin IIIB (MYO3B), transcript variant 2, mRNA. |
| MYO3B | intronic | SEQ ID 941 | NR_045684 | *Homo sapiens* myosin IIIB (MYO3B), transcript variant 5, non-coding RNA. |
| PLOD3 | exonic | SEQ ID 942 | NM_001084 | *Homo sapiens* procollagen-lysine, 2-oxoglutarate 5-dioxygenase 3 (PLOD3), mRNA. |
| MOGAT3 | exonic | SEQ ID 943 | NM_178176 | *Homo sapiens* monoacylglycerol O-acyltransferase 3 (MOGAT3), mRNA. |
| ZNHIT1 | exonic | SEQ ID 944 | NM_006349 | *Homo sapiens* zinc finger, HIT-type containing 1 (ZNHIT1), mRNA. |
| PPIL4 | exonic | SEQ ID 945 | NM_139126 | *Homo sapiens* peptidylprolyl isomerase (cyclophilin)-like 4 (PPIL4), mRNA. |
| PTPRA | exonic | SEQ ID 946 | NM_080840 | *Homo sapiens* protein tyrosine phosphatase, receptor type, A (PTPRA), transcript variant 2, mRNA. |
| PTPRA | exonic | SEQ ID 947 | NM_002836 | *Homo sapiens* protein tyrosine phosphatase, receptor type, A (PTPRA), transcript variant 1, mRNA. |
| PTPRA | exonic | SEQ ID 948 | NM_080841 | *Homo sapiens* protein tyrosine phosphatase, receptor type, A (PTPRA), transcript variant 3, mRNA. |
| PTPRC | exonic | SEQ ID 949 | NM_080921 | *Homo sapiens* protein tyrosine phosphatase, receptor type, C (PTPRC), transcript variant 2, mRNA. |
| PTPRC | exonic | SEQ ID 950 | NM_002838 | *Homo sapiens* protein tyrosine phosphatase, receptor type, C (PTPRC), transcript variant 1, mRNA. |
| FAM193A | exonic | SEQ ID 951 | NM_001256666 | *Homo sapiens* family with sequence similarity 193, member A (FAM193A), transcript variant 2, mRNA. |
| FAM193A | exonic | SEQ ID 952 | NM_001256667 | *Homo sapiens* family with sequence similarity 193, member A (FAM193A), transcript variant 4, mRNA. |
| FAM193A | exonic | SEQ ID 953 | NM_001256668 | *Homo sapiens* family with sequence similarity 193, member A (FAM193A), transcript variant 5, mRNA. |
| FAM193A | exonic | SEQ ID 954 | NM_003704 | *Homo sapiens* family with sequence similarity 193, member A (FAM193A), transcript variant 1, mRNA. |
| FAM193A | exonic | SEQ ID 955 | NR_046336 | *Homo sapiens* family with sequence similarity 193, member A (FAM193A), transcript variant 6, non-coding RNA. |
| FAM193A | exonic | SEQ ID 956 | NR_046335 | *Homo sapiens* family with sequence similarity 193, member A (FAM193A), transcript variant 3, non-coding RNA. |
| RNF4 | exonic | SEQ ID 957 | NM_002938 | *Homo sapiens* ring finger protein 4 (RNF4), transcript variant 2, mRNA. |
| RNF4 | exonic | SEQ ID 958 | NM_001185009 | *Homo sapiens* ring finger protein 4 (RNF4), transcript variant 1, mRNA. |

TABLE 4-continued

| RefSeq Gene Symbol | CNV Gene Region | SEQ ID | RefSeq Accession Number | RefSeq Gene Description/Definition |
|---|---|---|---|---|
| RNF4 | exonic | SEQ ID 959 | NM_001185010 | *Homo sapiens* ring finger protein 4 (RNF4), transcript variant 3, mRNA. |
| ROCK1 | exonic | SEQ ID 960 | NM_005406 | *Homo sapiens* Rho-associated, coiled-coil containing protein kinase 1 (ROCK1), mRNA. |
| RNF217 | exonic | SEQ ID 961 | NM_152553 | *Homo sapiens* ring finger protein 217 (RNF217), mRNA. |
| SFRP1 | exonic | SEQ ID 962 | NM_003012 | *Homo sapiens* secreted frizzled-related protein 1 (SFRP1), mRNA. |
| SRF | exonic | SEQ ID 963 | NM_003131 | *Homo sapiens* serum response factor (c-fos serum response element-binding transcription factor) (SRF), mRNA. |
| ISLR2 | exonic | SEQ ID 964 | NM_020851 | *Homo sapiens* immunoglobulin superfamily containing leucine-rich repeat 2 (ISLR2), transcript variant 2, mRNA. |
| LOC283731 | exonic | SEQ ID 965 | NR_027073 | *Homo sapiens* uncharacterized LOC283731 (LOC283731), non-coding RNA. |
| ISLR2 | exonic | SEQ ID 966 | NM_001130138 | *Homo sapiens* immunoglobulin superfamily containing leucine-rich repeat 2 (ISLR2), transcript variant 4, mRNA. |
| ISLR2 | exonic | SEQ ID 967 | NM_001130137 | *Homo sapiens* immunoglobulin superfamily containing leucine-rich repeat 2 (ISLR2), transcript variant 3, mRNA. |
| ISLR2 | exonic | SEQ ID 968 | NM_001130136 | *Homo sapiens* immunoglobulin superfamily containing leucine-rich repeat 2 (ISLR2), transcript variant 1, mRNA. |
| STRA6 | exonic | SEQ ID 969 | NM_001199041 | *Homo sapiens* stimulated by retinoic acid gene 6 homolog (mouse) (STRA6), transcript variant 7, mRNA. |
| STRA6 | exonic | SEQ ID 970 | NM_001142619 | *Homo sapiens* stimulated by retinoic acid gene 6 homolog (mouse) (STRA6), transcript variant 4, mRNA. |
| STRA6 | exonic | SEQ ID 971 | NM_001199040 | *Homo sapiens* stimulated by retinoic acid gene 6 homolog (mouse) (STRA6), transcript variant 6, mRNA. |
| STRA6 | exonic | SEQ ID 972 | NM_001142618 | *Homo sapiens* stimulated by retinoic acid gene 6 homolog (mouse) (STRA6), transcript variant 3, mRNA. |
| STRA6 | exonic | SEQ ID 973 | NM_001142617 | *Homo sapiens* stimulated by retinoic acid gene 6 homolog (mouse) (STRA6), transcript variant 1, mRNA. |
| STRA6 | exonic | SEQ ID 974 | NM_022369 | *Homo sapiens* stimulated by retinoic acid gene 6 homolog (mouse) (STRA6), transcript variant 2, mRNA. |
| ISLR | exonic | SEQ ID 975 | NM_201526 | *Homo sapiens* immunoglobulin superfamily containing leucine-rich repeat (ISLR), transcript variant 2, mRNA. |
| ISLR | exonic | SEQ ID 976 | NM_005545 | *Homo sapiens* immunoglobulin superfamily containing leucine-rich repeat (ISLR), transcript variant 1, mRNA. |
| STRA6 | exonic | SEQ ID 977 | NM_001142620 | *Homo sapiens* stimulated by retinoic acid gene 6 homolog (mouse) (STRA6), transcript variant 5, mRNA. |
| STRA6 | exonic | SEQ ID 978 | NM_001199042 | *Homo sapiens* stimulated by retinoic acid gene 6 homolog (mouse) (STRA6), transcript variant 8, mRNA. |
| SMYD3 | exonic | SEQ ID 979 | NM_022743 | *Homo sapiens* SET and MYND domain containing 3 (SMYD3), transcript variant 2, mRNA. |
| SMYD3 | exonic | SEQ ID 980 | NM_001167740 | *Homo sapiens* SET and MYND domain containing 3 (SMYD3), transcript variant 1, mRNA. |
| CNST | exonic | SEQ ID 981 | NM_001139459 | *Homo sapiens* consortin, connexin sorting protein (CNST), transcript variant 2, mRNA. |
| CNST | exonic | SEQ ID 982 | NM_152609 | *Homo sapiens* consortin, connexin sorting protein (CNST), transcript variant 1, mRNA. |
| TFB2M | exonic | SEQ ID 983 | NM_022366 | *Homo sapiens* transcription factor B2, mitochondrial (TFB2M), nuclear gene encoding mitochondrial protein, mRNA. |
| LOC255654 | exonic | SEQ ID 984 | NR_040002 | *Homo sapiens* uncharacterized LOC255654 (LOC255654), non-coding RNA. |
| TRPM4 | exonic | SEQ ID 985 | NM_001195227 | *Homo sapiens* transient receptor potential cation channel, subfamily M, member 4 (TRPM4), transcript variant 2, mRNA. |
| TRPM4 | exonic | SEQ ID 986 | NM_017636 | *Homo sapiens* transient receptor potential cation channel, subfamily M, member 4 (TRPM4), transcript variant 1, mRNA. |
| USP14 | exonic | SEQ ID 987 | NM_005151 | *Homo sapiens* ubiquitin specific peptidase 14 (tRNA-guanine transglycosylase) (USP14), transcript variant 1, mRNA. |
| USP14 | exonic | SEQ ID 988 | NM_001037334 | *Homo sapiens* ubiquitin specific peptidase 14 (tRNA-guanine transglycosylase) (USP14), transcript variant 2, mRNA. |
| BOLL | exonic | SEQ ID 989 | NM_033030 | *Homo sapiens* bol, boule-like (*Drosophila*) (BOLL), transcript variant 2, mRNA. |
| BOLL | exonic | SEQ ID 990 | NM_197970 | *Homo sapiens* bol, boule-like (*Drosophila*) (BOLL), transcript variant 1, mRNA. |
| TBK1 | exonic | SEQ ID 991 | NM_013254 | *Homo sapiens* TANK-binding kinase 1 (TBK1), mRNA. |
| XPOT | exonic | SEQ ID 992 | NM_007235 | *Homo sapiens* exportin, tRNA (XPOT), mRNA. |
| MIR548H4 | exonic | SEQ ID 993 | NR_031680 | *Homo sapiens* microRNA 548h-4 (MIR548H4), microRNA. |
| AHI1 | exonic | SEQ ID 994 | NM_017651 | *Homo sapiens* Abelson helper integration site 1 (AHI1), transcript variant 2, mRNA. |
| AHI1 | exonic | SEQ ID 995 | NM_001134831 | *Homo sapiens* Abelson helper integration site 1 (AHI1), transcript variant 1, mRNA. |
| LINC00271 | exonic | SEQ ID 996 | NR_026805 | *Homo sapiens* long intergenic non-protein coding RNA 271 (LINC00271), non-coding RNA. |
| AHI1 | exonic | SEQ ID 997 | NM_001134832 | *Homo sapiens* Abelson helper integration site 1 (AHI1), transcript variant 4, mRNA. |
| AHI1 | exonic | SEQ ID 998 | NM_001134830 | *Homo sapiens* Abelson helper integration site 1 (AHI1), transcript variant 3, mRNA. |
| ZFHX3 | exonic | SEQ ID 999 | NM_001164766 | *Homo sapiens* zinc finger homeobox 3 (ZFHX3), transcript variant B, mRNA. |
| ZFHX3 | exonic | SEQ ID 1000 | NM_006885 | *Homo sapiens* zinc finger homeobox 3 (ZFHX3), transcript variant A, mRNA. |
| HTA | exonic | SEQ ID 1001 | NR_027756 | *Homo sapiens* uncharacterized LOC283902 (HTA), non-coding RNA. |
| LOC100506172 | exonic | SEQ ID 1002 | NR_038234 | *Homo sapiens* uncharacterized LOC100506172 (LOC100506172), non-coding RNA. |
| HDAC9 | exonic | SEQ ID 1003 | NM_001204144 | *Homo sapiens* histone deacetylase 9 (HDAC9), transcript variant 6, mRNA. |
| ERG | exonic | SEQ ID 1004 | NM_001243432 | *Homo sapiens* v-ets erythroblastosis virus E26 oncogene homolog (avian) (ERG), transcript variant 7, mRNA. |
| ERG | exonic | SEQ ID 1005 | NM_001243428 | *Homo sapiens* v-ets erythroblastosis virus E26 oncogene homolog (avian) (ERG), transcript variant 5, mRNA. |

TABLE 4-continued

| RefSeq Gene Symbol | CNV Gene Region | SEQ ID | RefSeq Accession Number | RefSeq Gene Description/Definition |
|---|---|---|---|---|
| ERG | exonic | SEQ ID 1006 | NM_004449 | Homo sapiens v-ets erythroblastosis virus E26 oncogene homolog (avian) (ERG), transcript variant 2, mRNA. |
| ERG | exonic | SEQ ID 1007 | NM_001136154 | Homo sapiens v-ets erythroblastosis virus E26 oncogene homolog (avian) (ERG), transcript variant 3, mRNA. |
| ERG | exonic | SEQ ID 1008 | NM_001243429 | Homo sapiens v-ets erythroblastosis virus E26 oncogene homolog (avian) (ERG), transcript variant 6, mRNA. |
| DSCR4 | exonic | SEQ ID 1009 | NM_005867 | Homo sapiens Down syndrome critical region gene 4 (DSCR4), mRNA. |
| DSCR8 | exonic | SEQ ID 1010 | NR_026842 | Homo sapiens Down syndrome critical region gene 8 (DSCR8), transcript variant 2, non-coding RNA. |
| DSCR8 | exonic | SEQ ID 1011 | NR_026841 | Homo sapiens Down syndrome critical region gene 8 (DSCR8), transcript variant 1, non-coding RNA. |
| DSCR8 | exonic | SEQ ID 1012 | NR_026839 | Homo sapiens Down syndrome critical region gene 8 (DSCR8), transcript variant 3, non-coding RNA. |
| DSCR8 | exonic | SEQ ID 1013 | NR_026840 | Homo sapiens Down syndrome critical region gene 8 (DSCR8), transcript variant 5, non-coding RNA. |
| DSCR8 | exonic | SEQ ID 1014 | NR_026838 | Homo sapiens Down syndrome critical region gene 8 (DSCR8), transcript variant 4, non-coding RNA. |
| DSCR10 | exonic | SEQ ID 1015 | NR_027695 | Homo sapiens Down syndrome critical region gene 10 (non-protein coding) (DSCR10), non-coding RNA. |
| KCNJ15 | exonic | SEQ ID 1016 | NM_002243 | Homo sapiens potassium inwardly-rectifying channel, subfamily J, member 15 (KCNJ15), transcript variant 2, mRNA. |
| KCNJ15 | exonic | SEQ ID 1017 | NM_170737 | Homo sapiens potassium inwardly-rectifying channel, subfamily J, member 15 (KCNJ15), transcript variant 3, mRNA. |
| KCNJ15 | exonic | SEQ ID 1018 | NM_170736 | Homo sapiens potassium inwardly-rectifying channel, subfamily J, member 15 (KCNJ15), transcript variant 1, mRNA. |
| ERG | exonic | SEQ ID 1019 | NM_182918 | Homo sapiens v-ets erythroblastosis virus E26 oncogene homolog (avian) (ERG), transcript variant 1, mRNA. |
| ERG | exonic | SEQ ID 1020 | NM_001136155 | Homo sapiens v-ets erythroblastosis virus E26 oncogene homolog (avian) (ERG), transcript variant 4, mRNA. |

Computer-Implemented Aspects

As understood by those of ordinary skill in the art, the methods and information described herein (genetic variation association with neurological disorders) can be implemented, in all or in part, as computer executable instructions on known computer readable media. For example, the methods described herein can be implemented in hardware. Alternatively, the method can be implemented in software stored in, for example, one or more memories or other computer readable medium and implemented on one or more processors As is known, the processors can be associated with one or more controllers, calculation units and/or other units of a computer system, or implanted in firmware as desired. If implemented in software, the routines can be stored in any computer readable memory such as in RAM, ROM, flash memory, a magnetic disk, a laser disk, or other storage medium, as is also known. Likewise, this software can be delivered to a computing device via any known delivery method including, for example, over a communication channel such as a telephone line, the Internet, a wireless connection, etc., or via a transportable medium, such as a computer readable disk, flash drive, etc.

More generally, and as understood by those of ordinary skill in the art, the various steps described above can be implemented as various blocks, operations, tools, modules and techniques which, in turn, can be implemented in hardware, firmware, software, or any combination of hardware, firmware, and/or software. When implemented in hardware, some or all of the blocks, operations, techniques, etc. can be implemented in, for example, a custom integrated circuit (IC), an application specific integrated circuit (ASIC), a field programmable logic array (FPGA), a programmable logic array (PLA), etc.

Results from such genotyping can be stored in a data storage unit, such as a data carrier, including computer databases, data storage disks, or by other convenient data storage means. In certain embodiments, the computer database is an object database, a relational database or a post-relational database. Data can be retrieved from the data storage unit using any convenient data query method.

When implemented in software, the software can be stored in any known computer readable medium such as on a magnetic disk, an optical disk, or other storage medium, in a RAM or ROM or flash memory of a computer, processor, hard disk drive, optical disk drive, tape drive, etc. Likewise, the software can be delivered to a user or a computing system via any known delivery method including, for example, on a computer readable disk or other transportable computer storage mechanism.

The steps of the claimed methods can be operational with numerous other general purpose or special purpose computing system environments or configurations. Examples of well known computing systems, environments, and/or configurations that can be suitable for use with the methods or system of the claims include, but are not limited to, personal computers, server computers, hand-held or laptop devices, multiprocessor systems, microprocessor-based systems, set top boxes, programmable consumer electronics, network PCs, minicomputers, mainframe computers, distributed computing environments that include any of the above systems or devices, and the like.

The steps of the claimed method and system can be described in the general context of computer-executable instructions, such as program modules, being executed by a computer. Generally, program modules include routines, programs, objects, components, and/or data structures that perform particular tasks or implement particular abstract data types. The methods and apparatus can also be practiced in distributed computing environments where tasks are performed by remote processing devices that are linked through a communications network. In both integrated and distributed computing environments, program modules can be located in both local and remote computer storage media including memory storage devices. Numerous alternative embodiments could be implemented, using either current technology or technology developed after the filing date of this application, which would still fall within the scope of the claims defining the disclosure.

While the risk evaluation system and method, and other elements, have been described as preferably being implemented in software, they can be implemented in hardware, firmware, etc., and can be implemented by any other processor. Thus, the elements described herein can be implemented in a standard multi-purpose CPU or on specifically designed hardware or firmware such as an application-specific integrated circuit (ASIC) or other hard-wired device as desired. When implemented in software, the software routine can be stored in any computer readable memory such as on a magnetic disk, a laser disk, or other storage medium, in a RAM or ROM of a computer or processor, in any database, etc. Likewise, this software can be delivered to a user or a screening system via any known or desired delivery method including, for example, on a computer readable disk or other transportable computer storage mechanism or over a communication channel, for example, a telephone line, the internet, or wireless communication. Modifications and variations can be made in the techniques and structures described and illustrated herein without departing from the spirit and scope of the present disclosure.

PD Therapeutics

There is no cure for Parkinson's disease, but medications, surgery and multidisciplinary management can provide relief from the symptoms. The main families of drugs useful for treating motor symptoms are levodopa (usually combined with a dopa decarboxylase inhibitor or COMT inhibitor), dopamine agonists and MAO-B inhibitors. The stage of the disease determines which group is most useful. Two stages are usually distinguished: an initial stage in which the individual with PD has already developed some disability for which he needs pharmacological treatment, then a second stage in which an individual develops motor complications related to levodopa usage. Treatment in the initial stage aims for an optimal tradeoff between good symptom control and side-effects resulting from enhancement of dopaminergic function. The start of levodopa (or L-DOPA) treatment may be delayed by using other medications such as MAO-B inhibitors and dopamine agonists, in the hope of delaying the onset of dyskinesias. In the second stage the aim is to reduce symptoms while controlling fluctuations of the response to medication. Sudden withdrawals from medication or overuse have to be managed. When medications are not enough to control symptoms, surgery and deep brain stimulation can be of use. In the final stages of the disease, palliative care is provided to enhance quality of life.

Levodopa has been the most widely used treatment for over 30 years. L-DOPA is converted into dopamine in the dopaminergic neurons by dopa decarboxylase. Since motor symptoms are produced by a lack of dopamine in the substantia nigra, the administration of L-DOPA temporarily diminishes the motor symptoms. Only 5-10% of L-DOPA crosses the blood-brain barrier. The remainder is often metabolized to dopamine elsewhere, causing a variety of side effects including nausea, dyskinesias and joint stiffness. Carbidopa and benserazide are peripheral dopa decarboxylase inhibitors, which help to prevent the metabolism of L-DOPA before it reaches the dopaminergic neurons, therefore reducing side effects and increasing bioavailability. They are generally given as combination preparations with levodopa. Existing preparations are carbidopa/levodopa (co-careldopa) and benserazide/levodopa (co-beneldopa). Levodopa has been related to dopamine dysregulation syndrome, which is a compulsive overuse of the medication, and punding. There are controlled release versions of levodopa in the form intravenous and intestinal infusions that spread out the effect of the medication. These slow-release levodopa preparations have not shown an increased control of motor symptoms or motor complications when compared to immediate release preparations.

Tolcapone inhibits the COMT enzyme, which degrades dopamine, thereby prolonging the effects of levodopa. It has been used to complement levodopa; however, its usefulness is limited by possible side effects such as liver damage. A similarly effective drug, entacapone, has not been shown to cause significant alterations of liver function. Licensed preparations of entacapone contain entacapone alone or in combination with carbidopa and levodopa.

Levodopa preparations lead in the long term to the development of motor complications characterized by involuntary movements called dyskinesias and fluctuations in the response to medication. When this occurs a person with PD can change from phases with good response to medication and few symptoms ("on" state), to phases with no response to medication and significant motor symptoms ("off" state). For this reason, levodopa doses are kept as low as possible while maintaining functionality. Delaying the initiation of therapy with levodopa by using alternatives (dopamine agonists and MAO-B inhibitors) is common practice. A former strategy to reduce motor complications was to withdraw L-DOPA medication for some time. This is discouraged now, since it can bring dangerous side effects such as neuroleptic malignant syndrome. Most people with PD eventually need levodopa and later develop motor side effects.

Several dopamine agonists that bind to dopaminergic post-synaptic receptors in the brain have similar effects to levodopa. These were initially used for individuals experiencing on-off fluctuations and dyskinesias as a complementary therapy to levodopa; they are now mainly used on their own as an initial therapy for motor symptoms with the aim of delaying motor complications. When used in late PD they are useful at reducing the off periods. Dopamine agonists include bromocriptine, pergolide, pramipexole, ropinirole, piribedil, cabergoline, apomorphine and lisuride.

Dopamine agonists produce significant, although usually mild, side effects including drowsiness, hallucinations, insomnia, nausea and constipation. Sometimes side effects appear even at a minimal clinically effective dose, leading the physician to search for a different drug. Compared with levodopa, dopamine agonists may delay motor complications of medication use but are less effective at controlling symptoms. Nevertheless, they are usually effective enough to manage symptoms in the initial years. They tend to be more expensive than levodopa. Dyskinesias due to dopamine agonists are rare in younger people who have PD, but along with other side effects, become more common with age at onset. Thus dopamine agonists are the preferred initial treatment for earlier onset, as opposed to levodopa in later onset. Agonists have been related to impulse control disorders (such as compulsive sexual activity and eating, and pathological gambling and shopping) even more strongly than levodopa.

Apomorphine, a non-orally administered dopamine agonist, may be used to reduce off periods and dyskinesia in late PD. It is administered by intermittent injections or continuous subcutaneous infusions. Since secondary effects such as confusion and hallucinations are common, individuals receiving apomorphine treatment should be closely monitored. Two dopamine agonists that are administered through skin patches (lisuride and rotigotine) have been recently found to be useful for patients in initial stages and preliminary positive results has been published on the control of off states in patients in the advanced state.

MAO-B inhibitors (selegiline and rasagiline) increase the level of dopamine in the basal ganglia by blocking its metabolism. They inhibit monoamine oxidase-B (MAO-B) which breaks down dopamine secreted by the dopaminergic neurons. The reduction in MAO-B activity results in increased L-DOPA in the striatum. Like dopamine agonists, MAO-B inhibitors used as monotherapy improve motor symptoms and delay the need for levodopa in early disease, but produce more adverse effects and are less effective than levodopa. There are few studies of their effectiveness in the advanced stage, although results suggest that they are useful to reduce fluctuations between on and off periods. An initial study indicated that selegiline in combination with levodopa increased the risk of death, but this was later disproven.

Other drugs such as amantadine and anticholinergics may be useful as treatment of motor symptoms. However, the evidence supporting them lacks quality, so they are not first choice treatments. In addition to motor symptoms, PD is accompanied by a diverse range of symptoms. A number of drugs have been used to treat some of these problems. Examples are the use of clozapine for psychosis, cholinesterase inhibitors for dementia, and modafinil for daytime sleepiness. A 2010 meta-analysis found that non-steroidal anti-inflammatory drugs (apart from acetaminophen and aspirin), have been associated with at least a 15 percent (higher in long-term and regular users) reduction of incidence of the development of Parkinson's disease.

Treating motor symptoms with surgery was once a common practice, but since the discovery of levodopa, the number of operations declined. Studies in the past few decades have led to great improvements in surgical techniques, so that surgery is again being used in people with advanced PD for whom drug therapy is no longer sufficient. Surgery for PD can be divided in two main groups: lesional and deep brain stimulation (DBS). Target areas for DBS or lesions include the thalamus, the globus pallidus or the subthalamic nucleus. Deep brain stimulation (DBS) is the most commonly used surgical treatment. It involves the implantation of a medical device called a brain pacemaker, which sends electrical impulses to specific parts of the brain. DBS is recommended for people who have PD who suffer from motor fluctuations and tremor inadequately controlled by medication, or to those who are intolerant to medication, as long as they do not have severe neuropsychiatric problems. Other, less common, surgical therapies involve the formation of lesions in specific subcortical areas (a technique known as pallidotomy in the case of the lesion being produced in the globus pallidus).

There is some evidence that speech or mobility problems can improve with rehabilitation, although studies are scarce and of low quality. Regular physical exercise with or without physiotherapy can be beneficial to maintain and improve mobility, flexibility, strength, gait speed, and quality of life. However, when an exercise program is performed under the supervision of a physiotherapist, there are more improvements in motor symptoms, mental and emotional functions, daily living activities, and quality of life compared to a self-supervised exercise program at home. In terms of improving flexibility and range of motion for patients experiencing rigidity, generalized relaxation techniques such as gentle rocking have been found to decrease excessive muscle tension. Other effective techniques to promote relaxation include slow rotational movements of the extremities and trunk, rhythmic initiation, diaphragmatic breathing, and meditation techniques. As for gait and addressing the challenges associated with the disease such as hypokinesia (slowness of movement), shuffling and decreased arm swing; physiotherapists have a variety of strategies to improve functional mobility and safety. Areas of interest with respect to gait during rehabilitation programs focus on but are not limited to improving gait speed, base of support, stride length, trunk and arm swing movement. Strategies include utilizing assistive equipment (pole walking and treadmill walking), verbal cueing (manual, visual and auditory), exercises (marching and PNF patterns) and altering environments (surfaces, inputs, open vs. closed). Strengthening exercises have shown improvements in strength and motor function for patients with primary muscular weakness and weakness related to inactivity with mild to moderate Parkinson's disease. However, reports show a significant interaction between strength and the time the medications was taken. Therefore, it is recommended that patients should perform exercises 45 minutes to one hour after medications, when the patient is at their best. Also, due to the forward flexed posture, and respiratory dysfunctions in advanced Parkinson's disease, deep diaphragmatic breathing exercises are beneficial in improving chest wall mobility and vital capacity. Exercise may improve constipation.

One of the most widely practiced treatments for speech disorders associated with Parkinson's disease is the Lee Silverman voice treatment (LSVT). Speech therapy and specifically LSVT may improve speech. Occupational therapy (OT) aims to promote health and quality of life by helping people with the disease to participate in as many of their daily living activities as possible. There have been few studies on the effectiveness of OT and their quality is poor, although there is some indication that it may improve motor skills and quality of life for the duration of the therapy.

Muscles and nerves that control the digestive process may be affected by PD, resulting in constipation and gastroparesis (food remaining in the stomach for a longer period of time than normal). A balanced diet, based on periodical nutritional assessments, is recommended and should be designed to avoid weight loss or gain and minimize consequences of gastrointestinal dysfunction. As the disease advances, swallowing difficulties (dysphagia) may appear. In such cases it may be helpful to use thickening agents for liquid intake and an upright posture when eating, both measures reducing the risk of choking. Gastrostomy to deliver food directly into the stomach is possible in severe cases.

Levodopa and proteins use the same transportation system in the intestine and the blood-brain barrier, thereby competing for access. When they are taken together, this results in a reduced effectiveness of the drug. Therefore, when levodopa is introduced, excessive protein consumption is discouraged and well balanced Mediterranean diet is recommended. In advanced stages, additional intake of low-protein products such as bread or pasta is recommended for similar reasons. To minimize interaction with proteins, levodopa should be taken 30 minutes before meals. At the same time, regimens for PD restrict proteins during breakfast and lunch, allowing protein intake in the evening. A person skilled in the art will appreciate and understand that the genetic variants described herein in general may not, by themselves, provide an absolute identification of individuals who can develop a neurological disorder or related conditions. The variants described herein can indicate increased and/or decreased likelihood that individuals carrying the at-risk or protective variants of the disclosure can develop symptoms associated with a neurological disorder. This information can be used to, for example, initiate preventive measures at an early stage, perform regular physical and/or mental exams to monitor the progress and/or appearance of symptoms, or to schedule exams at a regular interval to identify early symptoms, so as to be able to apply treatment at an early stage. This is in particular important since neurological disorders and related disorders are heterogeneous disorders with symptoms that can be individually vague. Screening criteria can comprise a number of symptoms to be present over a period of time; therefore, it is important to be able to establish additional risk factors that can aid in the screening, or facilitate the screening through in-depth phenotyping and/or more frequent examination, or both. For example, individuals with early symptoms that typically are not individually associated with a clinical screening of a neurological disorder and carry an at-risk genetic variation can benefit from early therapeutic treatment, or other preventive measure, or more rigorous supervision or more frequent examination. Likewise, individuals that have a family history of the disease, or are carriers of other risk factors associated with a neurological disorder can, in the context of additionally carrying at least one at-risk genetic variation, benefit from early therapy or other treatment.

Early symptoms of behavioral disorders such as a neurological disorder and related conditions may not be sufficient to fulfill standardized screening criteria. To fulfill those, a certain pattern of symptoms and behavioral disturbance needs to manifest itself over a period of time. Sometimes, certain physical characteristics can also be present. This makes at-risk genetic variants valuable in a screening setting, in particular high-risk variants. Determination of the presence of such variants warrants increased monitoring of the individual in question. Appearance of symptoms combined with the presence of such variants facilitates early screening, which makes early treatment possible. Genetic testing can thus be used to aid in the screening of disease in its early stages, before all criteria for formal screening criteria are all fulfilled. It is well established that early treatment is extremely important for neurological disorders and related disorders, which lends further support to the value of genetic testing for early diagnosis, prognosis, or theranosis of these disorders.

The present disclosure provides methods for identifying compounds or agents that can be used to treat a neurological disorder. Thus, the genetic variations and associated polypeptides of the disclosure are useful as targets for the identification and/or development of therapeutic agents. In certain embodiments, such methods include assaying the ability of an agent or compound to modulate the activity and/or expression of a nucleic acid that is associated with at least one genetic variation described herein, encoded products of the gene sequence, and any other molecules or polypeptides associated with these genes. This in turn can be used to identify agents or compounds that inhibit, enhance, or alter the undesired activity, localization, binding and/or expression of the encoded nucleic acid product, such as mRNA or polypeptides. For example, in some embodiments, small molecule drugs can be developed to target the aberrant polypeptide(s) or RNA(s) resulting from specific disease-causing mutation(s) within a gene, such as described in: Peltz et al. (2009) RNA Biology 6(3):329-34; Van Goor et al. (2009) Proc. Natl. Acad. Sci. USA 106(44):18825-30; Van Goor et al. (2011) Proc. Natl. Acad. Sci. USA 108(46): 18843-8; Ramsey et al. (2011) N. Engl. J. Med. 365(18): 1663-72. The polypeptides associated with the CNVs listed in Table 1 are described in Table 4 as the accession number (accession) of mRNAs that would encode said polypeptides. Assays for performing such experiments can be performed in cell-based systems or in cell-free systems, as known to the skilled person. Cell-based systems include cells naturally expressing the nucleic acids of interest, or recombinant cells that have been genetically modified so as to express a certain desired nucleic acid molecule.

Variant gene expression in a subject can be assessed by expression of a variant-containing nucleic acid sequence or by altered expression of a normal/wild-type nucleic acid sequence due to variants affecting the level or pattern of expression of the normal transcripts, for example, variants in the regulatory or control region of the gene. Assays for gene expression include direct nucleic acid assays (mRNA), assays for expressed polypeptide levels, or assays of collateral compounds involved in a pathway, for example, a signal pathway. Furthermore, the expression of genes that are up- or down-regulated in response to the signal pathway can also be assayed. One embodiment includes operably linking a reporter gene, such as luciferase, to the regulatory region of one or more gene of interest.

Modulators of gene expression can in some embodiments be identified when a cell is contacted with a candidate compound or agent, and the expression of mRNA is determined. The expression level of mRNA in the presence of the candidate compound or agent is compared to the expression level in the absence of the compound or agent. Based on this comparison, candidate compounds or agents for treating a neurological disorder can be identified as those modulating the gene expression of the variant gene, or gene expression of one or more other genes occurring within the same biological pathway or known, for example, to be binding partners of the variant gene. When expression of mRNA or the encoded polypeptide is statistically significantly greater in the presence of the candidate compound or agent than in its absence, then the candidate compound or agent is identified as a stimulator or up-regulator of expression of the nucleic acid. When nucleic acid expression or polypeptide level is statistically significantly less in the presence of the candidate compound or agent than in its absence, then the candidate compound can be identified as an inhibitor or down-regulator of the nucleic acid expression. The disclosure further provides methods of treatment using a compound identified through drug (compound and/or agent) screening as a gene modulator.

The genetic variations described herein can be used to identify novel therapeutic targets for a neurological disorder. For example, genes containing, or in linkage disequilibrium with, the genetic variations, or their products, as well as genes or their products that are directly or indirectly regulated by or interact with these variant genes or their products, can be targeted for the development of therapeutic agents to treat a neurological disorder, or prevent or delay onset of symptoms associated with a neurological disorder. Therapeutic agents can comprise one or more of, for example, small non-polypeptide and non-nucleic acids, polypeptides, peptides, polypeptide fragments, nucleic acids (RNA, DNA, RNAJ, PNA (peptide nucleic acids), or their derivatives or mimetics which can modulate the function and/or levels of the target genes or their gene products. In some embodiments, treatment of PD can comprise treatment of one of the genes, or gene products derived thereof, such as mRNA or a polypeptide, with one or more of the therapeutics disclosed herein. In some embodiments, treatment of PD can comprise treatment of 2 or 3, or 4, or 5, or 6, or 7, or 8, or 9, or 10 or more of the genes, or gene products derived there from, with 2 or 3, or 4, or 5, or 6, or 7, or 8, or 9, or 10 or more of the therapeutics disclosed herein.

RNA Therapeutics

The nucleic acids and/or variants of the disclosure, or nucleic acids comprising their complementary sequence, can be used as antisense constructs to control gene expression in cells, tissues or organs. The methodology associated with antisense techniques is well known to the skilled artisan, and is described and reviewed in Antisense Drug Technology: Principles, Strategies, and Applications, Crooke, Marcel Dekker Inc., New York (2001) In general, antisense nucleic acids are designed to be complementary to a region of mRNA expressed by a gene, so that the antisense molecule hybridizes to the mRNA, thus blocking translation of the mRNA into a polypeptide Several classes of antisense oligonucleotide are known to those skilled in the art, including cleavers and blockers. The former bind to target RNA sites, activate intracellular nucleases {e.g., Rnase H or Rnase L) that cleave the target RNA. Blockers bind to target RNA, inhibit polypeptide translation by steric hindrance of the ribosomes. Examples of blockers include nucleic acids, morpholino compounds, locked nucleic acids and methylphosphonates (Thompson, Drug Discovery Today, 7:912-917 (2002)) Antisense oligonucleotides are useful directly as therapeutic agents, and are also useful for determining and validating gene function, for example, by gene knock-out or gene knock-down experiments. Antisense technology is further described in Layery et al., Curr. Opin. Drug Discov Devel 6 561-569 (2003), Stephens et al., Curr. Opin. Mol. Ther. 5.118-122 (2003), Kurreck, Eur. J. Biochem. 270.1628-44 (2003), Dias et al, Mol Cancer Ter. 1-347-55 (2002), Chen, Methods Mol. Med. 75:621-636 (2003), Wang et al., Curr Cancer Drug Targets 1.177-96 (2001), and Bennett, Antisense Nucleic Acid Drug. Dev. 12 215-24 (2002)

The variants described herein can be used for the selection and design of antisense reagents that are specific for particular variants (e.g., particular genetic variations, or polymorphic markers in LD with particular genetic variations). Using information about the variants described herein, antisense oligonucleotides or other antisense molecules that specifically target mRNA molecules that contain one or more variants of the disclosure can be designed. In this manner, expression of mRNA molecules that contain one or more variant of the present disclosure (markers and/or haplotypes) can be inhibited or blocked In some embodiments, the antisense molecules are designed to specifically bind a particular allelic form (i.e., one or several variants (alleles and/or haplotypes)) of the target nucleic acid, thereby inhibiting translation of a product originating from this specific allele or haplotype, but which do not bind other or alternate variants at the specific polymorphic sites of the target nucleic acid molecule.

As antisense molecules can be used to inactivate mRNA so as to inhibit gene expression, and thus polypeptide expression, the molecules can be used to treat a disease or disorder, such as a neurological disorder. The methodology can involve cleavage by means of ribozymes containing nucleotide sequences complementary to one or more regions in the mRNA that attenuate the ability of the mRNA to be translated Such mRNA regions include, for example, polypeptide-coding regions, in particular polypeptide-coding regions corresponding to catalytic activity, substrate and/or ligand binding sites, or other functional domains of a polypeptide.

The phenomenon of RNA interference (RNAi) has been actively studied for the last decade, since its original discovery in C. elegans (Fire et al., Nature 391:806-11 (1998)), and in recent years its potential use in treatment of human disease has been actively pursued (reviewed in Kim & Rossi, Nature Rev, Genet. 8: 173-204 (2007)). RNA interference (RNAi), also called gene silencing, is based on using double-stranded RNA molecules (dsRNA) to turn off specific genes. In the cell, cytoplasmic double-stranded RNA molecules (dsRNA) are processed by cellular complexes into small interfering RNA (siRNA). The siRNA guide the targeting of a polypeptide-RNA complex to specific sites on a target mRNA, leading to cleavage of the mRNA (Thompson, Drug Discovery Today, 7:912-917 (2002)). The siRNA molecules are typically about 20, 21, 22 or 23 nucleotides in length. Thus, one aspect of the disclosure relates to isolated nucleic acid sequences, and the use of those molecules for RNA interference, for example, as small interfering RNA molecules (siRNA). In some embodiments, the isolated nucleic acid sequences can be 18-26 nucleotides in length, preferably 19-25 nucleotides in length, more preferably 20-24 nucleotides in length, and more preferably 21, 22 or 23 nucleotides in length.

Another pathway for RNAi-mediated gene silencing originates in endogenously encoded primary microRNA (pn-miRNA) transcripts, which are processed in the cell to generate precursor miRNA (pre-miRNA). These miRNA molecules are exported from the nucleus to the cytoplasm, where they undergo processing to generate mature miRNA molecules (miRNA), which direct translational inhibition by recognizing target sites in the 3' untranslated regions of mRNAs, and subsequent mRNA degradation by processing P-bodies (reviewed in Kim & Rossi, Nature Rev. Genet. 8: 173-204 (2007)).

Clinical applications of RNAi include the incorporation of synthetic siRNA duplexes, which preferably are approximately 20-23 nucleotides in size, and preferably have 3' overlaps of 2 nucleotides. Knockdown of gene expression is established by sequence-specific design for the target mRNA. Several commercial sites for optimal design and synthesis of such molecules are known to those skilled in the art.

Other applications provide longer siRNA molecules (typically 25-30 nucleotides in length, preferably about 27 nucleotides), as well as small hairpin RNAs (shRNAs; typically about 29 nucleotides in length). The latter are naturally expressed, as described in Amarzguioui et al. (FEBS Lett. 579:5974-81 (2005)). Chemically synthetic siRNAs and shRNAs are substrates for in vivo processing, and in some cases provide more potent gene-silencing than shorter designs (Kim et al., Nature Biotechnol. 23:222-226 (2005); Siola et al., Nature Biotechnol. 23:227-231 (2005)). In general siRNAs provide for transient silencing of gene expression, because their intracellular concentration is diluted by subsequent cell divisions. By contrast, expressed shRNAs mediate long-term, stable knockdown of target transcripts, for as long as transcription of the shRNA takes place (Marques et al., Nature Biotechnol. 23.559-565 (2006), Brummelkamp et al., Science 296. 550-553 (2002)).

Since RNAi molecules, including siRNA, miRNA and shRNA, act in a sequence-dependent manner, variants described herein can be used to design RNAi reagents that recognize specific nucleic acids comprising specific genetic variations, alleles and/or haplotypes, while not recognizing nucleic acid sequences not comprising the genetic variation, or comprising other alleles or haplotypes. These RNAi reagents can thus recognize and destroy the target nucleic acid sequences. As with antisense reagents, RNAi reagents can be useful as therapeutic agents (i.e., for turning off disease-associated genes or disease-associated gene variants), but can also be useful for characterizing and validating gene function (e.g., by gene knock-out or gene knock-down experiments).

Delivery of RNAi can be performed by a range of methodologies known to those skilled in the art. Methods utilizing non-viral delivery include cholesterol, stable nucleic acid-lipid particle (SNALP), heavy-chain antibody fragment (Fab), aptamers and nanoparticles Viral delivery methods include use of lentivirus, adenovirus and adeno-associated virus The siRNA molecules are in some embodiments chemically modified to increase their stability. This can include modifications at the 2' position of the ribose, including 2'-O-methylpunnes and 2'-fluoropyrimidmes, which provide resistance to RNase activity. Other chemical modifications are possible and known to those skilled in the art.

The following references provide a further summary of RNAi, and possibilities for targeting specific genes using RNAi: Kim & Rossi, Nat. Rev. Genet. 8: 173-184 (2007), Chen & Rajewsky, Nat. Rev. Genet. 8: 93-103 (2007), Reynolds, et al., Nat. Biotechnol 22 326-330 (2004), Chi et al., Proc. Natl. Acad. Sa. USA 100-6343-6346 (2003), Vickers et al., J Biol. Chem. 278:7108-7118 (2003), Agami, Curr Opin. Chem. Biol. 6:829-834 (2002), Layery, et al., Curr. Opin. Drug Discov. Devel. 6:561-569 (2003), Shi, Trends Genet. 19:9-12 (2003), Shuey et al., Drug Discov. Today 7 1040-46 (2002), McManus et al., Nat. Rev. Genet. 3.737-747 (2002), Xia et al., Nat. Biotechnol. 20.1006-10 (2002), Plasterk et al., Curr. Opin Genet. Dev. 10 562-7 (2000), Bosher et al., Nat. Cell Biol. 2:E31-6 (2000), and Hunter, Curr. Biol. 9:R440-442 (1999).

A genetic defect leading to increased predisposition or risk for development of a disease, including a neurological disorder, or a defect causing the disease, can be corrected permanently by administering to a subject carrying the defect a nucleic acid fragment that incorporates a repair sequence that supplies the normal/wild-type nucleotide(s) at the site of the genetic defect. Such site-specific repair sequence can encompass an RNA/DNA oligonucleotide that operates to promote endogenous repair of a subject's genomic DNA. The administration of the repair sequence can be performed by an appropriate vehicle, such as a complex with polyethylamine, encapsulated in anionic liposomes, a viral vector such as an adenovirus vector, or other pharmaceutical compositions suitable for promoting intracellular uptake of the administered nucleic acid The genetic defect can then be overcome, since the chimeric oligonucleotides induce the incorporation of the normal sequence into the genome of the subject, leading to expression of the normal/wild-type gene product. The replacement is propagated, thus rendering a permanent repair and alleviation of the symptoms associated with the disease or condition.

Double stranded oligonucleotides are formed by the assembly of two distinct oligonucleotide sequences where the oligonucleotide sequence of one strand is complementary to the oligonucleotide sequence of the second strand; such double stranded oligonucleotides are generally assembled from two separate oligonucleotides (e.g., siRNA), or from a single molecule that folds on itself to form a double stranded structure (e.g., shRNA or short hairpin RNA). These double stranded oligonucleotides known in the art all have a common feature in that each strand of the duplex has a distinct nucleotide sequence, wherein only one nucleotide sequence region (guide sequence or the antisense sequence) has complementarity to a target nucleic acid sequence and the other strand (sense sequence) comprises nucleotide sequence that is homologous to the target nucleic acid sequence.

Double stranded RNA induced gene silencing can occur on at least three different levels: (i) transcription inactivation, which refers to RNA guided DNA or histone methylation; (ii) siRNA induced mRNA degradation; and (iii) mRNA induced transcriptional attenuation. It is generally considered that the major mechanism of RNA induced silencing (RNA interference, or RNAi) in mammalian cells is mRNA degradation. RNA interference (RNAi) is a mechanism that inhibits gene expression at the stage of translation or by hindering the transcription of specific genes. Specific RNAi pathway polypeptides are guided by the dsRNA to the targeted messenger RNA (mRNA), where they "cleave" the target, breaking it down into smaller portions that can no longer be translated into a polypeptide. Initial attempts to use RNAi in mammalian cells focused on the use of long strands of dsRNA. However, these attempts to induce RNAi met with limited success, due in part to the induction of the interferon response, which results in a general, as opposed to a target-specific, inhibition of polypeptide synthesis. Thus, long dsRNA is not a viable option for RNAi in mammalian systems. Another outcome is epigenetic changes to a gene—histone modification and DNA methylation—affecting the degree the gene is transcribed.

More recently it has been shown that when short (18-30 bp) RNA duplexes are introduced into mammalian cells in culture, sequence-specific inhibition of target mRNA can be realized without inducing an interferon response. Certain of these short dsRNAs, referred to as small inhibitory RNAs ("siRNAs"), can act catalytically at sub-molar concentrations to cleave greater than 95% of the target mRNA in the cell. A description of the mechanisms for siRNA activity, as well as some of its applications are described in Provost et al., Ribonuclease Activity and RNA Binding of Recombinant Human Dicer, E.M.B.O. J., 2002 Nov. 1; 21(21): 5864-5874; Tabara et al., The dsRNA Binding Protein RDE-4 Interacts with RDE-1, DCR-1 and a DexH-box Helicase to Direct RNAi in C. elegans, Cell 2002, June 28; 109(7):861-71; Ketting et al., Dicer Functions in RNA Interference and in Synthesis of Small RNA Involved in Neurological Timing in C. elegans; Martinez et al., Single-Stranded Antisense siRNAs Guide Target RNA Cleavage in RNAi, Cell 2002, September. 6; 110(5):563; Hutvagner & Zamore, A microRNA in a multiple-turnover RNAi enzyme complex, Science 2002, 297:2056.

From a mechanistic perspective, introduction of long double stranded RNA into plants and invertebrate cells is broken down into siRNA by a Type III endonuclease known as Dicer. Sharp, RNA interference—2001, Genes Dev. 2001, 15:485. Dicer, a ribonuclease-III-like enzyme, processes the dsRNA into 19-23 base pair short interfering RNAs with characteristic two base 3' overhangs. Bernstein, Caudy, Hammond, & Hannon, Role for a bidentate ribonuclease in the initiation step of RNA interference, Nature 2001, 409: 363. The siRNAs are then incorporated into an RNA-induced silencing complex (RISC) where one or more helicases unwind the siRNA duplex, enabling the complementary antisense strand to guide target recognition (Nykanen, Haley, & Zamore, ATP requirements and small interfering RNA structure in the RNA interference pathway, Cell 2001, 107:309). Upon binding to the appropriate target mRNA, one or more endonucleases within the RISC cleaves the target to induce silencing. Elbashir, Lendeckel, & Tuschl, RNA interference is mediated by 21- and 22-nucleotide RNAs, Genes Dev 2001, 15:188, FIG. 1.

Generally, the antisense sequence is retained in the active RISC complex and guides the RISC to the target nucleotide sequence by means of complementary base-pairing of the antisense sequence with the target sequence for mediating sequence-specific RNA interference. It is known in the art that in some cell culture systems, certain types of unmodified siRNAs can exhibit "off target" effects. It is hypothesized that this off-target effect involves the participation of the sense sequence instead of the antisense sequence of the siRNA in the RISC complex (see for example, Schwarz et al., 2003, Cell, 115, 199-208). In this instance the sense sequence is believed to direct the RISC complex to a sequence (off-target sequence) that is distinct from the intended target sequence, resulting in the inhibition of the off-target sequence. In these double stranded nucleic acid sequences, each strand is complementary to a distinct target nucleic acid sequence. However, the off-targets that are affected by these dsRNAs are not entirely predictable and are non-specific.

The term "siRNA" refers to small inhibitory RNA duplexes that induce the RNA interference (RNAi) pathway. These molecules can vary in length (generally between 18-30 basepairs) and contain varying degrees of complementarity to their target mRNA in the antisense strand. Some, but not all, siRNA have unpaired overhanging bases on the 5' or 3' end of the sense strand and/or the antisense strand. The term "siRNA" includes duplexes of two separate strands, as well as single strands that can form hairpin structures comprising a duplex region. Small interfering RNA (siRNA), sometimes known as short interfering RNA or silencing RNA, are a class of 20-25 nucleotide-long double-stranded RNA molecules that play a variety of roles in biology.

While the two RNA strands do not need to be completely complementary, the strands should be sufficiently complementary to hybridize to form a duplex structure. In some instances, the complementary RNA strand can be less than 30 nucleotides, preferably less than 25 nucleotides in length, more preferably 19 to 24 nucleotides in length, more preferably 20-23 nucleotides in length, and even more preferably 22 nucleotides in length. The dsRNA of the present disclosure can further comprise at least one single-stranded nucleotide overhang. The dsRNA of the present disclosure can further comprise a substituted or chemically modified nucleotide. As discussed in detail below, the dsRNA can be synthesized by standard methods known in the art.

siRNA can be divided into five (5) groups including non-functional, semi-functional, functional, highly functional, and hyper-functional based on the level or degree of silencing that they induce in cultured cell lines. As used herein, these definitions are based on a set of conditions where the siRNA is transfected into the cell line at a concentration of 100 nM and the level of silencing is tested at a time of roughly 24 hours after transfection, and not exceeding 72 hours after transfection. In this context, "non-functional siRNA" are defined as those siRNA that induce less than 50% (<50%) target silencing. "Semi-functional siRNA" induce 50-79% target silencing. "Functional siRNA" are molecules that induce 80-95% gene silencing. "Highly-functional siRNA" are molecules that induce greater than 95% gene silencing. "Hyperfunctional siRNA" are a special class of molecules. For purposes of this document, hyperfunctional siRNA are defined as those molecules that: (1) induce greater than 95% silencing of a specific target when they are transfected at subnanomolar concentrations (i.e., less than one nanomolar); and/or (2) induce functional (or better) levels of silencing for greater than 96 hours. These relative functionalities (though not intended to be absolutes) can be used to compare siRNAs to a particular target for applications such as functional genomics, target identification and therapeutics.

microRNAs (miRNA) are single-stranded RNA molecules of about 21-23 nucleotides in length, which regulate gene expression. miRNAs are encoded by genes that are transcribed from DNA but not translated into a polypeptide (non-coding RNA); instead they are processed from primary transcripts known as pri-miRNA to short stem-loop structures called pre-miRNA and finally to functional miRNA. Mature miRNA molecules are partially complementary to one or more messenger RNA (mRNA) molecules, and their main function is to downregulate gene expression.

Antibody-Based Therapeutics

The present disclosure embodies agents that modulate a peptide sequence or RNA expressed from a gene associated with a neurological disorder. The term "biomarker", as used herein, can comprise a genetic variation of the present disclosure or a gene product, for example, RNA and polypeptides, of any one of the genes listed in Table 2 or 3 or nucleotide transcripts of Table 4. Such modulating agents include, but are not limited to, polypeptides, peptidomimetics, peptoids, or any other forms of a molecule, which bind to, and alter the signaling or function associated with the a neurological disorder associated biomarker, have an inhibitory or stimulatory effect on the neurological disorder associated biomarkers, or have a stimulatory or inhibitory effect on the expression or activity of the a neurological disorder associated biomarkers' ligands, for example, polyclonal antibodies and/or monoclonal antibodies that specifically bind one form of the gene product but not to the other form of the gene product are also provided, or which bind a portion of either the variant or the reference gene product that contains the polymorphic site or sites.

In some embodiments, the present disclosure provides antibody-based agents targeting a neurological disorder associated biomarkers. The antibody-based agents in any suitable form of an antibody e.g., monoclonal, polyclonal, or synthetic, can be utilized in the therapeutic methods disclosed herein. The antibody-based agents include any target-binding fragment of an antibody and also peptibodies, which are engineered therapeutic molecules that can bind to human drug targets and contain peptides linked to the constant domains of antibodies. In some embodiments, the antibodies used for targeting a neurological disorder associated biomarkers are humanized antibodies. Methods for humanizing antibodies are well known in the art. In some embodiments, the therapeutic antibodies comprise an antibody generated against a neurological disorder associated biomarkers described in the present disclosure, wherein the antibodies are conjugated to another agent or agents, for example, a cytotoxic agent or agents.

The term "antibody" as used herein refers to immunoglobulin molecules and immunologically active portions of immunoglobulin molecules, i.e., molecules that contain antigen-binding sites that specifically bind an antigen. A molecule that specifically binds to a polypeptide of the disclosure is a molecule that binds to that polypeptide or a fragment thereof, but does not substantially bind other molecules in a nucleic acid sample, which naturally contains the polypeptide. Examples of immunologically active portions of immunoglobulin molecules include F(ab) and F(ab')2 fragments which can be generated by treating the antibody with an enzyme such as pepsin. The disclosure provides polyclonal and monoclonal antibodies that bind to a polypeptide of the disclosure. The term "monoclonal antibody" or "monoclonal antibody composition", as used herein, refers to a population of antibody molecules that contain only one species of an antigen binding site capable of immunoreacting with a particular epitope of a polypeptide of the disclosure. A monoclonal antibody composition thus typically displays a single binding affinity for a particular polypeptide of the disclosure with which it immunoreacts.

Polyclonal antibodies can be prepared as described above by immunizing a suitable subject with a desired immunogen, e.g., polypeptide of the disclosure or a fragment thereof. The antibody titer in the immunized subject can be monitored over time by standard techniques, such as with an enzyme linked immunosorbent assay (ELISA) using immobilized polypeptide. If desired, the antibody molecules directed against the polypeptide can be isolated from the mammal (e.g., from the blood) and further purified by well-known techniques, such as protein A chromatography to obtain the IgG fraction. At an appropriate time after immunization, e.g., when the antibody titers are highest, antibody-producing cells can be obtained from the subject and used to prepare monoclonal antibodies by standard techniques, such as the hybridoma technique originally described by Kohler and Milstein, Nature 256:495-497 (1975), the human B cell hybridoma technique (Kozbor et al., Immunol Today 4: 72 (1983)), the EBV-hybndoma technique (Cole et al., Monoclonal Antibodies and Cancer Therapy, Alan R. Liss (1985) Inc., pp. 77-96) or trioma techniques. The technology for producing hybridomas is well known (see generally Current Protocols in Immunology (1994) Coligan et al., (eds.) John Wiley & Sons, Inc., New York, N.Y.). Briefly, an immortal cell line (typically a myeloma) is fused to lymphocytes (typically splenocytes) from a mammal immunized with an immunogen as described above, and the culture supernatants of the resulting hybridoma cells are screened to identify a hybridoma producing a monoclonal antibody that binds a polypeptide of the disclosure.

Any of the many well known protocols used for fusing lymphocytes and immortalized cell lines can be applied for the purpose of generating a monoclonal antibody to a polypeptide of the disclosure (see, e.g., Current Protocols in Immunology, supra; Galfre et al., Nature 266:55052 (1977); R. H. Kenneth, in Monoclonal Antibodies: A New Dimension In Biological Analyses, Plenum Publishing Corp., New York, N.Y. (1980); and Lerner, Yale J. Biol. Med. 54:387-402 (1981)). Moreover, the ordinarily skilled worker can appreciate that there are many variations of such methods that also would be useful. Alternative to preparing monoclonal antibody-secreting hybridomas, a monoclonal antibody to a polypeptide of the disclosure can be identified and isolated by screening a recombinant combinatorial immunoglobulin library (e.g., an antibody phage display library) with the polypeptide to thereby isolate immunoglobulin library members that bind the polypeptide. Kits for generating and screening phage display libraries are commercially available (e.g., the Pharmacia Recombinant Phage Antibody System, Catalog No. 27-9400-01; and the Stratagene SurfZAP$^a$ Phage Display Kit, Catalog No. 240612). Additionally, examples of methods and reagents particularly amenable for use in generating and screening antibody display library can be found in, for example, U.S. Pat. No. 5,223,409; PCT Publication Nos. WO 92/18619, WO 91/17271, WO 92/20791, WO 92/15679; WO 93/01288, WO 92/01047, WO 92/09690, and WO 90/02809; Fuchs et al., Bio/Technology 9: 1370-1372 (1991); Hay et al., Hum. Antibod. Hybridomas 3:81-85 (1992); Huse et al., Science 246: 1275-1281 (1989); and Griffiths et al., EMBO J. 12:725-734 (1993).

Additionally, recombinant antibodies, such as chimeric and humanized monoclonal antibodies, comprising both human and non-human portions, which can be made using standard recombinant DNA techniques, are within the scope of the disclosure. Such chimeric and humanized monoclonal antibodies can be produced by recombinant DNA techniques known in the art.

In general, antibodies of the disclosure (e.g., a monoclonal antibody) can be used to isolate a polypeptide of the disclosure by standard techniques, such as affinity chromatography or immunoprecipitation. A polypeptide-specific antibody can facilitate the purification of natural polypeptide from cells and of recombinants produced polypeptide expressed in host cells Moreover, an antibody specific for a polypeptide of the disclosure can be used to detect the polypeptide (e.g., in a cellular lysate, cell supernatant, or tissue sample) in order to evaluate the abundance and pattern of expression of the polypeptide. Antibodies can be used diagnostically, prognostically, or theranostically to monitor polypeptide levels in tissue as part of a clinical testing procedure, e.g., to, for example, determine the efficacy of a given treatment regimen. The antibody can be coupled to a detectable substance to facilitate its detection. Examples of detectable substances include various enzymes, prosthetic groups, fluorescent materials, luminescent materials, bioluminescent materials, and radioactive materials. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotnazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$. Antibodies can also be useful in pharmacogenomic analysis. In such embodiments, antibodies against variant polypeptides encoded by nucleic acids according to the disclosure, such as variant polypeptides that are encoded by nucleic acids that contain at least one genetic variation of the disclosure, can be used to identify individuals that can benefit from modified treatment modalities.

Antibodies can furthermore be useful for assessing expression of variant polypeptides in disease states, such as in active stages of a disease, or in an individual with a predisposition to a disease related to the function of the polypeptide, in particular a neurological disorder. Antibodies specific for a variant polypeptide of the present disclosure that is encoded by a nucleic acid that comprises at least one polymorphic marker or haplotype as described herein can be used to screen for the presence of the variant polypeptide, for example, to screen for a predisposition to a neurological disorder as indicated by the presence of the variant polypeptide.

Antibodies can be used in other methods. Thus, antibodies are useful as screening tools for evaluating polypeptides, such as variant polypeptides of the disclosure, in conjunction with analysis by electrophoretic mobility, isoelectric point, tryptic or other protease digest, or for use in other physical assays known to those skilled in the art. Antibodies can also be used in tissue typing. In one such embodiment, a specific variant polypeptide has been correlated with expression in a specific tissue type, and antibodies specific for the variant polypeptide can then be used to identify the specific tissue type.

Subcellular localization of polypeptides, including variant polypeptides, can also be determined using antibodies, and can be applied to assess aberrant subcellular localization of the polypeptide in cells in various tissues. Such use can be applied in genetic testing, but also in monitoring a particular treatment modality. In the case where treatment is aimed at correcting the expression level or presence of the variant polypeptide or aberrant tissue distribution or neurological expression of the variant polypeptide, antibodies specific for the variant polypeptide or fragments thereof can be used to monitor therapeutic efficacy.

Antibodies are further useful for inhibiting variant polypeptide function, for example, by blocking the binding of a variant polypeptide to a binding molecule or partner. Such uses can also be applied in a therapeutic context in which treatment involves inhibiting a variant polypeptide's function. An antibody can be for example, be used to block or competitively inhibit binding, thereby modulating (i.e., agonizing or antagonizing) the activity of the polypeptide. Antibodies can be prepared against specific polypeptide fragments containing sites for specific function or against an intact polypeptide that is associated with a cell or cell membrane.

The present disclosure also embodies the use of any pharmacologic agent that can be conjugated to an antibody or an antibody binding fragment, and delivered in active form. Examples of such agents include cytotoxins, radioisotopes, hormones such as a steroid, anti-metabolites such as cytosines, and chemotherapeutic agents. Other embodiments can include agents such as a coagulant, a cytokine, growth factor, bacterial endotoxin or a moiety of bacterial endotoxin. The targeting antibody-based agent directs the toxin to, and thereby selectively modulates the cell expressing the targeted surface receptor. In some embodiments, therapeutic antibodies employ cross-linkers that provide high in vivo stability (Thorpe et al., Cancer Res., 48:6396, 1988). In any event, it is proposed that agents such as these can, if desired, be successfully conjugated to antibodies or antibody binding fragments, in a manner that can allow their targeting, internalization, release or presentation at the site of the targeted cells expressing the PD associated biomarkers using known conjugation technology. For administration in vivo, for example, an antibody can be linked with an additional therapeutic payload, such as radionuclide, an enzyme, an immunogenic epitope, or a cytotoxic agent, including bacterial toxins (diphtheria or plant toxins, such as ricin). The in vivo half-life of an antibody or a fragment thereof can be increased by pegylation through conjugation to polyethylene glycol.

Gene Therapy

In some embodiments, gene therapy can be used as a therapeutic to modulate a peptide sequence or RNA expressed from a gene associated with a developmental disorder. Gene therapy involves the use of DNA as a pharmaceutical agent to treat disease. DNA can be used to supplement or alter genes within an individual's cells as a therapy to treat disease. Gene therapy can be used to alter the signaling or function associated with the a developmental disorder associated biomarker, have an inhibitory or stimulatory effect on the developmental disorder associated biomarkers, or have a stimulatory or inhibitory effect on the expression or activity of the a developmental disorder associated biomarkers' ligands. In one embodiment, gene therapy involves using DNA that encodes a functional, therapeutic gene in order to replace a mutated gene. Other forms involve directly correcting a mutation, or using DNA that encodes a therapeutic polypeptide drug (rather than a natural human gene) to provide treatment. DNA that encodes a therapeutic polypeptide can be packaged within a vector, which can used to introduce the DNA inside cells within the body. Once inside, the DNA becomes expressed by the cell machinery, resulting in the production of the therapeutic, which in turn can treat the subject's disease.

Gene therapy agents and other agents for testing therapeutics can include plasmids, viral vectors, artificial chromosomes and the like containing therapeutic genes or polynucleotides encoding therapeutic products, including coding sequences for small interfering RNA (siRNA), ribozymes and antisense RNA, which in certain further embodiments can comprise an operably linked promoter such as a constitutive promoter or a regulatable promoter, such as an inducible promoter (e.g., IPTG inducible), a tightly regulated promoter (e.g., a promoter that permits little or no detectable transcription in the absence of its cognate inducer or derepressor) or a tissue-specific promoter. Methodologies for preparing, testing and using these and related agents are known in the art. See, e.g., Ausubel (Ed.), Current Protocols in Molecular Biology (2007 John Wiley & Sons, NY); Rosenzweig and Nabel (Eds), Current Protocols in Human Genetics (esp. Ch. 13 therein, "Delivery Systems for Gene Therapy", 2008 John Wiley & Sons, NY); Abell, Advances in Amino Acid Mimetics and Peptidomimetics, 1997 Elsevier, NY. In another embodiment, gene therapy agents may encompass zinc finger nuclease (ZFN) or transcription activator-like effector nuclease (TALEN) strategies, see for example: Urnov et al. (2010), Nature Reviews Genetics 11(9):636-46; Yusa et al. (2011), Nature 478(7369):391-4; Bedell et al. (2012), Nature ePub September 23, PubMed ID 23000899.

As a non-limiting example, one such embodiment contemplates introduction of a gene therapy agent for treating PD (e.g., an engineered therapeutic virus, a therapeutic agent-carrying nanoparticle, etc.) to one or more injection sites in a subject, without the need for imaging, surgery, or histology on biopsy specimens. Of course, periodic monitoring of the circulation for leaked therapeutic agent and/or subsequent analysis of a biopsy specimen, e.g., to assess the effects of the agent on the target tissue, can also be considered. A gene therapy includes a therapeutic polynucleotide administered before, after, or at the same time as any other therapy described herein. In some embodiments, therapeutic genes may include an antisense version of a biomarker disclosed herein, a sequence of a biomarker described herein, or an inhibitor of a biomarker disclosed herein.

Methods of Treatment

Some embodiments of the present disclosure relates to methods of using pharmaceutical compositions and kits comprising agents that can inhibit one or more neurological disorder associated biomarker to inhibit or decrease neurological disorder progression. Another embodiment of the present disclosure provides methods, pharmaceutical compositions, and kits for the treatment of animal subjects. The term "animal subject" as used herein includes humans as well as other mammals. The term "treating" as used herein includes achieving a therapeutic benefit and/or a prophylactic benefit. By therapeutic benefit is meant eradication or amelioration of the underlying viral infection. Also, a therapeutic benefit is achieved with the eradication or amelioration of one or more of the physiological symptoms associated a neurological disorder such that an improvement is observed in the animal subject, notwithstanding the fact that the animal subject can still be afflicted with a neurological disorder.

For embodiments where a prophylactic benefit is desired, a pharmaceutical composition of the disclosure can be administered to a subject at risk of developing a neurological disorder, or to a subject reporting one or more of the physiological symptoms of a neurological disorder, even though a screening of the condition cannot have been made. Administration can prevent a neurological disorder from developing, or it can reduce, lessen, shorten and/or otherwise ameliorate the progression of a neurological disorder, or symptoms that develop. The pharmaceutical composition can modulate or target a neurological disorder associated biomarker. Wherein, the term modulate includes inhibition of a neurological disorder associated biomarkers or alternatively activation of a neurological disorder associated biomarkers.

Reducing the activity of one or more neurological disorder's associated biomarkers is also referred to as "inhibiting" the neurological disorder's associated biomarkers. The term "inhibits" and its grammatical conjugations, such as "inhibitory," do not require complete inhibition, but refer to a reduction in a neurological disorder's associated biomarkers' activities. In some embodiments such reduction is by at least 5%, at least 10%, at least 20%, at least 30%, at least 40%, at least 50%, at least 75%, at least 90%, and can be by at least 95% of the activity of the enzyme or other biologically important molecular process in the absence of the inhibitory effect, e.g., in the absence of an inhibitor. Conversely, the phrase "does not inhibit" and its grammatical conjugations refer to situations where there is less than 20%, less than 10%, and can be less than 5%, of reduction in enzyme or other biologically important molecular activity in the presence of the agent. Further the phrase "does not substantially inhibit" and its grammatical conjugations refer to situations where there is less than 30%, less than 20%, and in some embodiments less than 10% of reduction in enzyme or other biologically important molecular activity in the presence of the agent.

Increasing the activity and/or function of polypeptides and/or nucleic acids found to be associated with one or more neurological disorders, is also referred to as "activating" the polypeptides and/or nucleic acids. The term "activated" and its grammatical conjugations, such as "activating," do not require complete activation, but refer to an increase in a neurological disorder associated biomarkers' activities. In some embodiments such increase is by at least 5%, at least 10%, at least 20%, at least 30%, at least 40%, at least 50%, at least 60%, at least 70%, at least 75%, at least 80%, at least 85%, at least 90%, and can be by at least 95% of the activity of the enzyme or other biologically important molecular process in the absence of the activation effect, e.g., in the absence of an activator. Conversely, the phrase "does not activate" and its grammatical conjugations refer to situations where there can be less than 20%, less than 10%, and less than 5%, of an increase in enzyme or other biologically important molecular activity in the presence of the agent. Further the phrase "does not substantially activate" and its grammatical conjugations refer to situations where there is less than 30%, less than 20%, and in some embodiments less than 10% of an increase in enzyme or other biologically important molecular activity in the presence of the agent.

The ability to reduce enzyme activity is a measure of the potency or the activity of an agent, or combination of agents, towards or against the enzyme or other biologically important molecular process. Potency can be measured by cell free, whole cell and/or in vivo assays in terms of IC50, Ki and/or ED50 values. An IC50 value represents the concentration of an agent required to inhibit enzyme activity by half (50%) under a given set of conditions. A Ki value represents the equilibrium affinity constant for the binding of an inhibiting agent to the enzyme or other relevant biomolecule. An ED50 value represents the dose of an agent required to affect a half-maximal response in a biological assay. Further details of these measures will be appreciated by those of ordinary skill in the art, and can be found in standard texts on biochemistry, enzymology, and the like.

The present disclosure also includes kits that can be used to treat neurological disorders These kits comprise an agent or combination of agents that inhibits a neurological disorder associated biomarker or a neurological disorder associated biomarkers and in some embodiments instructions teaching the use of the kit according to the various methods and approaches described herein. Such kits can also include information, such as scientific literature references, package insert materials, clinical trial results, and/or summaries of these and the like, which indicate or establish the activities and/or advantages of the agent. Such information can be based on the results of various studies, for example, studies using experimental animals involving in vivo models and studies based on human clinical trials. Kits described herein can be provided, marketed and/or promoted to health providers, including physicians, nurses, pharmacists, formulary officials, and the like.

In some aspects a host cell can be used for testing or administering therapeutics. In some embodiments, a host cell can comprise a nucleic acid comprising expression control sequences operably-linked to a coding region. The host cell can be natural or non-natural. The non-natural host used in aspects of the method can be any cell capable of expressing a nucleic acid of the disclosure including, bacterial cells, fungal cells, insect cells, mammalian cells and plant cells. In some aspects the natural host is a mammalian tissue cell and the non-natural host is a different mammalian tissue cell. Other aspects of the method include a natural host that is a first cell normally residing in a first mammalian species and the non-natural host is a second cell normally residing in a second mammalian species. In another alternative aspect, the method uses a first cell and the second cell that are from the same tissue type. In those aspects of the method where the coding region encodes a mammalian polypeptide, the mammalian polypeptide may be a hormone. In other aspects the coding region may encode a neuropeptide, an antibody, an antimetabolite, or a polypeptide or nucleotide therapeutic.

Expression control sequences can be those nucleotide sequences, both 5' and 3' to a coding region, that are required for the transcription and translation of the coding region in a host organism. Regulatory sequences include a promoter, ribosome binding site, optional inducible elements and sequence elements required for efficient 3' processing, including polyadenylation. When the structural gene has been isolated from genomic DNA, the regulatory sequences also include those intronic sequences required for splicing of the introns as part of mRNA formation in the target host.

Formulations, Routes of Administration, and Effective Doses

Yet another aspect of the present disclosure relates to formulations, routes of administration and effective doses for pharmaceutical compositions comprising an agent or combination of agents of the instant disclosure. Such pharmaceutical compositions can be used to treat a neurological disorder progression and a neurological disorder associated symptoms as described above.

Compounds of the disclosure can be administered as pharmaceutical formulations including those suitable for oral (including buccal and sub-lingual), rectal, nasal, topical, transdermal patch, pulmonary, vaginal, suppository, or parenteral (including intramuscular, intraarterial, intrathecal, intradermal, intraperitoneal, subcutaneous and intravenous) administration or in a form suitable for administration by aerosolization, inhalation or insufflation. General information on drug delivery systems can be found in Ansel et al., Pharmaceutical Dosage Forms and Drug Delivery Systems (Lippencott Williams & Wilkins, Baltimore Md. (1999).

In various embodiments, the pharmaceutical composition includes carriers and excipients (including but not limited to buffers, carbohydrates, mannitol, polypeptides, amino acids, antioxidants, bacteriostats, chelating agents, suspending agents, thickening agents and/or preservatives), water, oils including those of petroleum, animal, vegetable or synthetic origin, such as peanut oil, soybean oil, mineral oil, sesame oil and the like, saline solutions, aqueous dextrose and glycerol solutions, flavoring agents, coloring agents, detackifiers and other acceptable additives, adjuvants, or binders, other pharmaceutically acceptable auxiliary substances to approximate physiological conditions, such as pH buffering agents, tonicity adjusting agents, emulsifying agents, wetting agents and the like. Examples of excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. In some embodiments, the pharmaceutical preparation is substantially free of preservatives. In other embodiments, the pharmaceutical preparation can contain at least one preservative. General methodology on pharmaceutical dosage forms is found in Ansel et al., Pharmaceutical Dosage Forms and Drug Delivery Systems (Lippencott, Williams, & Wilkins, Baltimore Md. (1999)). It can be recognized that, while any suitable carrier known to those of ordinary skill in the art can be employed to administer the compositions of this disclosure, the type of carrier can vary depending on the mode of administration.

Compounds can also be encapsulated within liposomes using well-known technology. Biodegradable microspheres can also be employed as carriers for the pharmaceutical compositions of this disclosure. Suitable biodegradable microspheres are disclosed, for example, in U.S. Pat. Nos. 4,897,268, 5,075,109, 5,928,647, 5,811,128, 5,820,883, 5,853,763, 5,814,344 and 5,942,252.

The compound can be administered in liposomes or microspheres (or microparticles). Methods for preparing liposomes and microspheres for administration to a subject are well known to those of skill in the art. U.S. Pat. No. 4,789,734, the contents of which are hereby incorporated by reference, describes methods for encapsulating biological materials in liposomes. Essentially, the material is dissolved in an aqueous solution, the appropriate phospholipids and lipids added, and along with surfactants if required, and the material dialyzed or sonicated, as necessary. A review of known methods is provided by G. Gregoriadis, Chapter 14, "Liposomes," Drug Carriers in Biology and Medicine, pp. 2.sup.87-341 (Academic Press, 1979).

Microspheres formed of polymers or polypeptides are well known to those skilled in the art, and can be tailored for passage through the gastrointestinal tract directly into the blood stream. Alternatively, the compound can be incorporated and the microspheres, or composite of microspheres, implanted for slow release over a period of time ranging from days to months. See, for example, U.S. Pat. Nos. 4,906,474, 4,925,673 and 3,625,214, and Jein, TIPS 19:155-157 (1998), the contents of which are hereby incorporated by reference.

The concentration of drug can be adjusted, the pH of the solution buffered and the isotonicity adjusted to be compatible with intravenous injection, as is well known in the art.

The compounds of the disclosure can be formulated as a sterile solution or suspension, in suitable vehicles, well known in the art. The pharmaceutical compositions can be sterilized by conventional, well-known sterilization techniques, or can be sterile filtered. The resulting aqueous solutions can be packaged for use as is, or lyophilized, the lyophilized preparation being combined with a sterile solution prior to administration. Suitable formulations and additional carriers are described in Remington "The Science and Practice of Pharmacy" (20th Ed., Lippincott Williams & Wilkins, Baltimore Md.), the teachings of which are incorporated by reference in their entirety herein.

The agents or their pharmaceutically acceptable salts can be provided alone or in combination with one or more other agents or with one or more other forms. For example, a formulation can comprise one or more agents in particular proportions, depending on the relative potencies of each agent and the intended indication. For example, in compositions for targeting two different host targets, and where potencies are similar, about a 1:1 ratio of agents can be used. The two forms can be formulated together, in the same dosage unit e.g., in one cream, suppository, tablet, capsule, aerosol spray, or packet of powder to be dissolved in a beverage; or each form can be formulated in a separate unit, e.g., two creams, two suppositories, two tablets, two capsules, a tablet and a liquid for dissolving the tablet, two aerosol sprays, or a packet of powder and a liquid for dissolving the powder, etc.

The term "pharmaceutically acceptable salt" means those salts which retain the biological effectiveness and properties of the agents used in the present disclosure, and which are not biologically or otherwise undesirable. For example, a pharmaceutically acceptable salt does not interfere with the beneficial effect of an agent of the disclosure in inhibiting a neurological disorder associated biomarkers' components Typical salts are those of the inorganic ions, such as, for example, sodium, potassium, calcium, magnesium ions, and the like. Such salts include salts with inorganic or organic acids, such as hydrochloric acid, hydrobromic acid, phosphoric acid, nitric acid, sulfuric acid, methanesulfonic acid, p toluenesulfonic acid, acetic acid, fumaric acid, succinic acid, lactic acid, mandelic acid, malic acid, citric acid, tartaric acid or maleic acid. In addition, if the agent(s) contain a carboxy group or other acidic group, it can be converted into a pharmaceutically acceptable addition salt with inorganic or organic bases. Examples of suitable bases include sodium hydroxide, potassium hydroxide, ammonia, cyclohexylamine, dicyclohexyl-amine, ethanolamine, diethanolamine, triethanolamine, and the like.

A pharmaceutically acceptable ester or amide refers to those which retain biological effectiveness and properties of the agents used in the present disclosure, and which are not biologically or otherwise undesirable. For example, the ester or amide does not interfere with the beneficial effect of an agent of the disclosure in inhibiting a neurological disorder associated biomarkers' components. Typical esters include ethyl, methyl, isobutyl, ethylene glycol, and the like. Typical amides include unsubstituted amides, alkyl amides, dialkyl amides, and the like.

In some embodiments, an agent can be administered in combination with one or more other compounds, forms, and/or agents, e.g., as described above. Pharmaceutical compositions comprising combinations of a neurological disorder associated biomarkers' inhibitors with one or more other active agents can be formulated to comprise certain molar ratios. For example, molar ratios of about 99:1 to about 1:99 of a neurological disorder's associated biomarkers' inhibitors to the other active agent can be used. In some subset of the embodiments, the range of molar ratios of neurological disorder's associated biomarkers' inhibitors: other active agents are selected from about 80:20 to about 20:80; about 75:25 to about 25:75, about 70:30 to about 30:70, about 66:33 to about 33:66, about 60:40 to about 40:60; about 50:50; and about 90:10 to about 10:90. The molar ratio of neurological disorder's associated biomarkers' inhibitors: other active agents can be about 1:9, and in some embodiments can be about 1:1. The two agents, forms and/or compounds can be formulated together, in the same dosage unit e.g., in one cream, suppository, tablet, capsule, or packet of powder to be dissolved in a beverage; or each agent, form, and/or compound can be formulated in separate units, e.g., two creams, suppositories, tablets, two capsules, a tablet and a liquid for dissolving the tablet, an aerosol spray a packet of powder and a liquid for dissolving the powder, etc.

If necessary or desirable, the agents and/or combinations of agents can be administered with still other agents. The choice of agents that can be co-administered with the agents and/or combinations of agents of the instant disclosure can depend, at least in part, on the condition being treated. Agents of particular use in the formulations of the present disclosure include, for example, any agent having a therapeutic effect for a viral infection, including, e.g., drugs used to treat inflammatory conditions. For example, in treatments for influenza, in some embodiments formulations of the instant disclosure can additionally contain one or more conventional anti-inflammatory drugs, such as an NSAID, e.g., ibuprofen, naproxen, acetaminophen, ketoprofen, or aspirin. In some alternative embodiments for the treatment of influenza formulations of the instant disclosure can additionally contain one or more conventional influenza antiviral agents, such as amantadine, rimantadine, zanamivir, and oseltamivir. In treatments for retroviral infections, such as HIV, formulations of the instant disclosure can additionally contain one or more conventional antiviral drug, such as protease inhibitors (lopinavir/ritonavir {Kaletra}, indinavir {Crixivan}, ritonavir {Norvir}, nelfinavir {Viracept}, saquinavir hard gel capsules {Invirase}, atazanavir {Reyataz}, amprenavir {Agenerase}, fosamprenavir {Telzir}, tipranavir{Aptivus}), reverse transcriptase inhibitors, including non-Nucleoside and Nucleoside/nucleotide inhibitors (AZT {zidovudine, Retrovir}, ddI {didanosine, Videx}, 3TC {lamivudine, Epivir}, d4T {stavudine, Zerit}, abacavir {Ziagen}, FTC {emtricitabine, Emtriva}, tenofovir {Viread}, efavirenz {Sustiva} and nevirapine {Viramune}), fusion inhibitors T20 {enfuvirtide, Fuzeon}, integrase inhibitors (MK-0518 and GS-9137), and maturation inhibitors (PA-457 {Bevirimat}). As another example, formulations can additionally contain one or more supplements, such as vitamin C, E or other anti-oxidants.

The agent(s) (or pharmaceutically acceptable salts, esters or amides thereof) can be administered per se or in the form of a pharmaceutical composition wherein the active agent(s) is in an admixture or mixture with one or more pharmaceutically acceptable carriers. A pharmaceutical composition, as used herein, can be any composition prepared for administration to a subject. Pharmaceutical compositions for use in accordance with the present disclosure can be formulated in conventional manner using one or more physiologically acceptable carriers, comprising excipients, diluents, and/or auxiliaries, e.g., which facilitate processing of the active agents into preparations that can be administered. Proper formulation can depend at least in part upon the route of administration chosen. The agent(s) useful in the present disclosure, or pharmaceutically acceptable salts, esters, or amides thereof, can be delivered to a subject using a number of routes or modes of administration, including oral, buccal, topical, rectal, transdermal, transmucosal, subcutaneous, intravenous, and intramuscular applications, as well as by inhalation.

For oral administration, the agents can be formulated readily by combining the active agent(s) with pharmaceutically acceptable carriers well known in the art. Such carriers enable the agents of the disclosure to be formulated as tablets, including chewable tablets, pills, dragees, capsules, lozenges, hard candy, liquids, gels, syrups, slurries, powders, suspensions, elixirs, wafers, and the like, for oral ingestion by a subject to be treated. Such formulations can comprise pharmaceutically acceptable carriers including solid diluents or fillers, sterile aqueous media and various non-toxic organic solvents. A solid carrier can be one or more substances which can also act as diluents, flavoring agents, solubilizers, lubricants, suspending agents, binders, preservatives, tablet disintegrating agents, or an encapsulating material. In powders, the carrier generally is a finely divided solid which is a mixture with the finely divided active component. In tablets, the active component generally is mixed with the carrier having the necessary binding capacity in suitable proportions and compacted in the shape and size desired. The powders and tablets preferably contain from about one (1) to about seventy (70) percent of the active compound. Suitable carriers include but are not limited to magnesium carbonate, magnesium stearate, talc, sugar, lactose, pectin, dextrin, starch, gelatin, tragacanth, methylcellulose, sodium carboxymethylcellulose, a low melting wax, cocoa butter, and the like. Generally, the agents of the disclosure can be included at concentration levels ranging from about 0.5%, about 5%, about 10%, about 20%, or about 30% to about 50%, about 60%, about 70%, about 80% or about 90% by weight of the total composition of oral dosage forms, in an amount sufficient to provide a desired unit of dosage.

Aqueous suspensions for oral use can contain agent(s) of this disclosure with pharmaceutically acceptable excipients, such as a suspending agent (e.g., methyl cellulose), a wetting agent (e.g., lecithin, lysolecithin and/or a long-chain fatty alcohol), as well as coloring agents, preservatives, flavoring agents, and the like.

In some embodiments, oils or non-aqueous solvents can be used to bring the agents into solution, due to, for example, the presence of large lipophilic moieties. Alternatively, emulsions, suspensions, or other preparations, for example, liposomal preparations, can be used. With respect to liposomal preparations, any known methods for preparing liposomes for treatment of a condition can be used. See, for example, Bangham et al., J. Mol. Biol. 23: 238-252 (1965) and Szoka et al., Proc. Natl. Acad. Sci. USA 75: 4194-4198 (1978), incorporated herein by reference. Ligands can also be attached to the liposomes to direct these compositions to particular sites of action. Agents of this disclosure can also be integrated into foodstuffs, e.g., cream cheese, butter, salad dressing, or ice cream to facilitate solubilization, administration, and/or compliance in certain subject populations.

Pharmaceutical preparations for oral use can be obtained as a solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; flavoring elements, cellulose preparations such as, for example, maize starch, wheat starch, rice starch, potato starch, gelatin, gum tragacanth, methyl cellulose, hydroxypropylmethyl cellulose, sodium carboxymethylcellulose, and/or polyvinyl pyrrolidone (PVP). If desired, disintegrating agents can be added, such as the cross linked polyvinyl pyrrolidone, agar, or alginic acid or a salt thereof such as sodium alginate. The agents can also be formulated as a sustained release preparation.

Dragee cores can be provided with suitable coatings. For this purpose, concentrated sugar solutions can be used, which can optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments can be added to the tablets or dragee coatings for identification or to characterize different combinations of active agents.

Pharmaceutical preparations that can be used orally include push fit capsules made of gelatin, as well as soft, sealed capsules made of gelatin and a plasticizer, such as glycerol or sorbitol. The push fit capsules can contain the active ingredients in admixture with filler such as lactose, binders such as starches, and/or lubricants such as talc or magnesium stearate and, optionally, stabilizers. In soft capsules, the active agents can be dissolved or suspended in suitable liquids, such as fatty oils, liquid paraffin, or liquid polyethylene glycols. In addition, stabilizers can be added. All formulations for oral administration should be in dosages suitable for administration.

Other forms suitable for oral administration include liquid form preparations including emulsions, syrups, elixirs, aqueous solutions, aqueous suspensions, or solid form preparations which are intended to be converted shortly before use to liquid form preparations. Emulsions can be prepared in solutions, for example, in aqueous propylene glycol solutions or can contain emulsifying agents, for example, such as lecithin, sorbitan monooleate, or acacia. Aqueous solutions can be prepared by dissolving the active component in water and adding suitable colorants, flavors, stabilizers, and thickening agents. Aqueous suspensions can be prepared by dispersing the finely divided active component in water with viscous material, such as natural or synthetic gums, resins, methylcellulose, sodium carboxymethylcellulose, and other well known suspending agents. Suitable fillers or carriers with which the compositions can be administered include agar, alcohol, fats, lactose, starch, cellulose derivatives, polysaccharides, polyvinylpyrrolidone, silica, sterile saline and the like, or mixtures thereof used in suitable amounts. Solid form preparations include solutions, suspensions, and emulsions, and can contain, in addition to the active component, colorants, flavors, stabilizers, buffers, artificial and natural sweeteners, dispersants, thickeners, solubilizing agents, and the like.

A syrup or suspension can be made by adding the active compound to a concentrated, aqueous solution of a sugar, e.g., sucrose, to which can also be added any accessory ingredients. Such accessory ingredients can include flavoring, an agent to retard crystallization of the sugar or an agent to increase the solubility of any other ingredient, e.g., as a polyhydric alcohol, for example, glycerol or sorbitol.

When formulating compounds of the disclosure for oral administration, it can be desirable to utilize gastroretentive formulations to enhance absorption from the gastrointestinal (GI) tract. A formulation which is retained in the stomach for several hours can release compounds of the disclosure slowly and provide a sustained release that can be preferred in some embodiments of the disclosure. Disclosure of such gastroretentive formulations are found in Klausner, E. A.; Lavy, E.; Barta, M.; Cserepes, E.; Friedman, M.; Hoffman, A. 2003 "Novel gastroretentive dosage forms: evaluation of gastroretentivity and its effect on levodopa in humans." Pharm. Res. 20, 1466-73, Hoffman, A.; Stepensky, D.; Lavy, E.; Eyal, S. Klausner, E.; Friedman, M. 2004 "Pharmacokinetic and pharmacodynamic aspects of gastroretentive dosage forms" Int. J. Pharm. 11, 141-53, Streubel, A.; Siepmann, J.; Bodmeier, R.; 2006 "Gastroretentive drug delivery systems" Expert Opin. Drug Deliver. 3, 217-3, and Chavanpatil, M. D.; Jain, P.; Chaudhari, S.; Shear, R.; Vavia, P. R. "Novel sustained release, swellable and bioadhesive gastroretentive drug delivery system for olfoxacin" Int. J. Pharm. 2006. Expandable, floating and bioadhesive techniques can be utilized to maximize absorption of the compounds of the disclosure.

The compounds of the disclosure can be formulated for parenteral administration (e.g., by injection, for example, bolus injection or continuous infusion) and can be presented in unit dose form in ampoules, pre-filled syringes, small volume infusion or in multi-dose containers with an added preservative. The compositions can take such forms as suspensions, solutions, or emulsions in oily or aqueous vehicles, for example, solutions in aqueous polyethylene glycol.

For injectable formulations, the vehicle can be chosen from those known in art to be suitable, including aqueous solutions or oil suspensions, or emulsions, with sesame oil, corn oil, cottonseed oil, or peanut oil, as well as elixirs, mannitol, dextrose, or a sterile aqueous solution, and similar pharmaceutical vehicles. The formulation can also comprise polymer compositions which are biocompatible, biodegradable, such as poly(lactic-co-glycolic)acid. These materials can be made into micro or nanospheres, loaded with drug and further coated or derivatized to provide superior sustained release performance. Vehicles suitable for periocular or intraocular injection include, for example, suspensions of therapeutic agent in injection grade water, liposomes and vehicles suitable for lipophilic substances. Other vehicles for periocular or intraocular injection are well known in the art.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition can also include a solubilizing agent and a local anesthetic such as lidocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients can be mixed prior to administration.

When administration is by injection, the active compound can be formulated in aqueous solutions, specifically in physiologically compatible buffers such as Hanks solution, Ringer's solution, or physiological saline buffer. The solution can contain formulatory agents such as suspending, stabilizing and/or dispersing agents. Alternatively, the active compound can be in powder form for constitution with a suitable vehicle, e.g., sterile pyrogen-free water, before use. In some embodiments, the pharmaceutical composition does not comprise an adjuvant or any other substance added to enhance the immune response stimulated by the peptide. In some embodiments, the pharmaceutical composition comprises a substance that inhibits an immune response to the peptide. Methods of formulation are known in the art, for example, as disclosed in Remington's Pharmaceutical Sciences, latest edition, Mack Publishing Co., Easton P.

In addition to the formulations described previously, the agents can also be formulated as a depot preparation. Such long acting formulations can be administered by implantation or transcutaneous delivery (for example, subcutaneously or intramuscularly), intramuscular injection or use of a transdermal patch. Thus, for example, the agents can be formulated with suitable polymeric or hydrophobic materials (for example, as an emulsion in an acceptable oil) or ion exchange resins, or as sparingly soluble derivatives, for example, as a sparingly soluble salt.

In some embodiments, pharmaceutical compositions comprising one or more agents of the present disclosure exert local and regional effects when administered topically or injected at or near particular sites of infection. Direct topical application, e.g., of a viscous liquid, solution, suspension, dimethylsulfoxide (DMSO)-based solutions, liposomal formulations, gel, jelly, cream, lotion, ointment, suppository, foam, or aerosol spray, can be used for local administration, to produce for example, local and/or regional effects. Pharmaceutically appropriate vehicles for such formulation include, for example, lower aliphatic alcohols, polyglycols (e.g., glycerol or polyethylene glycol), esters of fatty acids, oils, fats, silicones, and the like. Such preparations can also include preservatives (e.g., p-hydroxybenzoic acid esters) and/or antioxidants (e.g., ascorbic acid and tocopherol). See also Dermatological Formulations: Percutaneous absorption, Barry (Ed.), Marcel Dekker Incl, 1983.

Pharmaceutical compositions of the present disclosure can contain a cosmetically or dermatologically acceptable carrier. Such carriers are compatible with skin, nails, mucous membranes, tissues and/or hair, and can include any conventionally used cosmetic or dermatological carrier meeting these requirements. Such carriers can be readily selected by one of ordinary skill in the art. In formulating skin ointments, an agent or combination of agents of the instant disclosure can be formulated in an oleaginous hydrocarbon base, an anhydrous absorption base, a water-in-oil absorption base, an oil-in-water water-removable base and/or a water-soluble base. Examples of such carriers and excipients include, but are not limited to, humectants (e.g., urea), glycols (e.g., propylene glycol), alcohols (e.g., ethanol), fatty acids (e.g., oleic acid), surfactants (e.g., isopropyl myristate and sodium lauryl sulfate), pyrrolidones, glycerol monolaurate, sulfoxides, terpenes (e.g., menthol), amines, amides, alkanes, alkanols, water, calcium carbonate, calcium phosphate, various sugars, starches, cellulose derivatives, gelatin, and polymers such as polyethylene glycols.

Ointments and creams can, for example, be formulated with an aqueous or oily base with the addition of suitable thickening and/or gelling agents. Lotions can be formulated with an aqueous or oily base and can in general also contain one or more emulsifying agents, stabilizing agents, dispersing agents, suspending agents, thickening agents, or coloring agents. The construction and use of transdermal patches for the delivery of pharmaceutical agents is well known in the art. See, e.g., U.S. Pat. Nos. 5,023,252, 4,992,445 and 5,001,139. Such patches can be constructed for continuous, pulsatile, or on demand delivery of pharmaceutical agents.

Lubricants which can be used to form pharmaceutical compositions and dosage forms of the disclosure include, but are not limited to, calcium stearate, magnesium stearate, mineral oil, light mineral oil, glycerin, sorbitol, mannitol, polyethylene glycol, other glycols, stearic acid, sodium lauryl sulfate, talc, hydrogenated vegetable oil (e.g., peanut oil, cottonseed oil, sunflower oil, sesame oil, olive oil, corn oil, and soybean oil), zinc stearate, ethyl oleate, ethyl laureate, agar, or mixtures thereof. Additional lubricants include, for example, a syloid silica gel, a coagulated aerosol of synthetic silica, or mixtures thereof. A lubricant can optionally be added, in an amount of less than about 1 weight percent of the pharmaceutical composition.

The compositions according to the present disclosure can be in any form suitable for topical application, including aqueous, aqueous-alcoholic or oily solutions, lotion or serum dispersions, aqueous, anhydrous or oily gels, emulsions obtained by dispersion of a fatty phase in an aqueous phase (O/W or oil in water) or, conversely, (W/O or water in oil), microemulsions or alternatively microcapsules, microparticles or lipid vesicle dispersions of ionic and/or nonionic type. These compositions can be prepared according to conventional methods. Other than the agents of the disclosure, the amounts of the various constituents of the compositions according to the disclosure are those conventionally used in the art. These compositions in particular constitute protection, treatment or care creams, milks, lotions, gels or foams for the face, for the hands, for the body and/or for the mucous membranes, or for cleansing the skin. The compositions can also consist of solid preparations constituting soaps or cleansing bars.

Compositions of the present disclosure can also contain adjuvants common to the cosmetic and dermatological fields, such as hydrophilic or lipophilic gelling agents, hydrophilic or lipophilic active agents, preserving agents, antioxidants, solvents, fragrances, fillers, sunscreens, odor-absorbers and dyestuffs. The amounts of these various adjuvants are those conventionally used in the fields considered and, for example, are from about 0.01% to about 20% of the total weight of the composition. Depending on their nature, these adjuvants can be introduced into the fatty phase, into the aqueous phase and/or into the lipid vesicles.

In some embodiments, ocular viral infections can be effectively treated with ophthalmic solutions, suspensions, ointments or inserts comprising an agent or combination of agents of the present disclosure. Eye drops can be prepared by dissolving the active ingredient in a sterile aqueous solution such as physiological saline, buffering solution, etc., or by combining powder compositions to be dissolved before use. Other vehicles can be chosen, as is known in the art, including but not limited to: balance salt solution, saline solution, water soluble polyethers such as polyethylene glycol, polyvinyls, such as polyvinyl alcohol and povidone, cellulose derivatives such as methylcellulose and hydroxypropyl methylcellulose, petroleum derivatives such as mineral oil and white petrolatum, animal fats such as lanolin, polymers of acrylic acid such as carboxypolymethylene gel, vegetable fats such as peanut oil and polysaccharides such as dextrans, and glycosaminoglycans such as sodium hyaluronate. If desired, additives ordinarily used in the eye drops can be added. Such additives include isotonizing agents (e.g., sodium chloride, etc.), buffer agent (e.g., boric acid, sodium monohydrogen phosphate, sodium dihydrogen phosphate, etc.), preservatives (e.g., benzalkonium chloride, benzethonium chloride, chlorobutanol, etc.), thickeners (e.g., saccharide such as lactose, mannitol, maltose, etc.; e.g., hyaluronic acid or its salt such as sodium hyaluronate, potassium hyaluronate, etc.; e.g., mucopolysaccharide such as chondroitin sulfate, etc.; e.g., sodium polyacrylate, carboxyvinyl polymer, crosslinked polyacrylate, polyvinyl alcohol, polyvinyl pyrrolidone, methyl cellulose, hydroxy propyl methylcellulose, hydroxyethyl cellulose, carboxymethyl cellulose, hydroxy propyl cellulose or other agents known to those skilled in the art).

The solubility of the components of the present compositions can be enhanced by a surfactant or other appropriate co-solvent in the composition. Such cosolvents include polysorbate 20, 60, and 80, Pluronic F68, F-84 and P-103, cyclodextrin, or other agents known to those skilled in the art. Such co-solvents can be employed at a level of from about 0.01% to 2% by weight.

The compositions of the disclosure can be packaged in multidose form. Preservatives can be preferred to prevent microbial contamination during use. Suitable preservatives include: benzalkonium chloride, thimerosal, chlorobutanol, methyl paraben, propyl paraben, phenylethyl alcohol, edetate disodium, sorbic acid, Onamer M, or other agents known to those skilled in the art. In the prior art ophthalmic products, such preservatives can be employed at a level of from 0.004% to 0.02%. In the compositions of the present application the preservative, preferably benzalkonium chloride, can be employed at a level of from 0.001% to less than 0.01%, e.g. from 0.001% to 0.008%, preferably about 0.005% by weight. It has been found that a concentration of benzalkonium chloride of 0.005% can be sufficient to preserve the compositions of the present disclosure from microbial attack.

In some embodiments, neurological disorder associated symptoms of the ear can be effectively treated with otic solutions, suspensions, ointments or inserts comprising an agent or combination of agents of the present disclosure.

In some embodiments, the agents of the present disclosure are delivered in soluble rather than suspension form, which allows for more rapid and quantitative absorption to the sites of action. In general, formulations such as jellies, creams, lotions, suppositories and ointments can provide an area with more extended exposure to the agents of the present disclosure, while formulations in solution, e.g., sprays, provide more immediate, short-term exposure.

In some embodiments relating to topical/local application, the pharmaceutical compositions can include one or more penetration enhancers. For example, the formulations can comprise suitable solid or gel phase carriers or excipients that increase penetration or help delivery of agents or combinations of agents of the disclosure across a permeability barrier, e.g., the skin. Many of these penetration-enhancing compounds are known in the art of topical formulation, and include, e.g., water, alcohols (e.g., terpenes like methanol, ethanol, 2-propanol), sulfoxides (e.g., dimethyl sulfoxide, decylmethyl sulfoxide, tetradecylmethyl sulfoxide), pyrrolidones (e.g., 2-pyrrolidone, N-methyl-2-pyrrolidone, N-(2-hydroxyethyl)pyrrolidone), laurocapram, acetone, dimethylacetamide, dimethylformamide, tetrahydrofurfuryl alcohol, L-α-amino acids, anionic, cationic, amphoteric or nonionic surfactants (e.g., isopropyl myristate and sodium lauryl sulfate), fatty acids, fatty alcohols (e.g., oleic acid), amines, amides, clofibric acid amides, hexamethylene lauramide, proteolytic enzymes, α-bisabolol, d-limonene, urea and N,N-diethyl-m-toluamide, and the like. Additional examples include humectants (e.g., urea), glycols (e.g., propylene glycol and polyethylene glycol), glycerol monolaurate, alkanes, alkanols, ORGELASE, calcium carbonate, calcium phosphate, various sugars, starches, cellulose derivatives, gelatin, and/or other polymers. In some embodiments, the pharmaceutical compositions can include one or more such penetration enhancers.

In some embodiments, the pharmaceutical compositions for local/topical application can include one or more antimicrobial preservatives such as quaternary ammonium compounds, organic mercurials, p-hydroxy benzoates, aromatic alcohols, chlorobutanol, and the like.

Gastrointestinal neurological disorder symptoms can be effectively treated with orally- or rectally delivered solutions, suspensions, ointments, enemas and/or suppositories comprising an agent or combination of agents of the present disclosure.

Respiratory neurological disorder symptoms can be effectively treated with aerosol solutions, suspensions or dry powders comprising an agent or combination of agents of the present disclosure. Administration by inhalation is particularly useful in treating viral infections of the lung, such as influenza. The aerosol can be administered through the respiratory system or nasal passages. For example, one skilled in the art can recognize that a composition of the present disclosure can be suspended or dissolved in an appropriate carrier, e.g., a pharmaceutically acceptable propellant, and administered directly into the lungs using a nasal spray or inhalant. For example, an aerosol formulation comprising a neurological disorder associated biomarkers' inhibitors can be dissolved, suspended or emulsified in a propellant or a mixture of solvent and propellant, e.g., for administration as a nasal spray or inhalant. Aerosol formulations can contain any acceptable propellant under pressure, such as a cosmetically or dermatologically or pharmaceutically acceptable propellant, as conventionally used in the art.

An aerosol formulation for nasal administration is generally an aqueous solution designed to be administered to the nasal passages in drops or sprays. Nasal solutions can be similar to nasal secretions in that they are generally isotonic and slightly buffered to maintain a pH of about 5.5 to about 6.5, although pH values outside of this range can additionally be used. Antimicrobial agents or preservatives can also be included in the formulation.

An aerosol formulation for inhalations and inhalants can be designed so that the agent or combination of agents of the present disclosure is carried into the respiratory tree of the subject when administered by the nasal or oral respiratory route. Inhalation solutions can be administered, for example, by a nebulizer. Inhalations or insufflations, comprising finely powdered or liquid drugs, can be delivered to the respiratory system as a pharmaceutical aerosol of a solution or suspension of the agent or combination of agents in a propellant, e.g., to aid in disbursement. Propellants can be liquefied gases, including halocarbons, for example, fluorocarbons such as fluorinated chlorinated hydrocarbons, hydrochlorofluorocarbons, and hydrochlorocarbons, as well as hydrocarbons and hydrocarbon ethers.

Halocarbon propellants useful in the present disclosure include fluorocarbon propellants in which all hydrogens are replaced with fluorine, chlorofluorocarbon propellants in which all hydrogens are replaced with chlorine and at least one fluorine, hydrogen-containing fluorocarbon propellants, and hydrogen-containing chlorofluorocarbon propellants.

Halocarbon propellants are described in Johnson, U.S. Pat. No. 5,376,359; Byron et al., U.S. Pat. No. 5,190,029; and Purewal et al., U.S. Pat. No. 5,776,434. Hydrocarbon propellants useful in the disclosure include, for example, propane, isobutane, n-butane, pentane, isopentane and neopentane. A blend of hydrocarbons can also be used as a propellant. Ether propellants include, for example, dimethyl ether as well as the ethers. An aerosol formulation of the disclosure can also comprise more than one propellant. For example, the aerosol formulation can comprise more than one propellant from the same class, such as two or more fluorocarbons; or more than one, more than two, more than three propellants from different classes, such as a fluorohydrocarbon and a hydrocarbon. Pharmaceutical compositions of the present disclosure can also be dispensed with a compressed gas, e.g., an inert gas such as carbon dioxide, nitrous oxide or nitrogen.

Aerosol formulations can also include other components, for example, ethanol, isopropanol, propylene glycol, as well as surfactants or other components such as oils and detergents. These components can serve to stabilize the formulation and/or lubricate valve components.

The aerosol formulation can be packaged under pressure and can be formulated as an aerosol using solutions, suspensions, emulsions, powders and semisolid preparations. For example, a solution aerosol formulation can comprise a solution of an agent of the disclosure such as a neurological disorder associated biomarkers' inhibitors in (substantially) pure propellant or as a mixture of propellant and solvent. The solvent can be used to dissolve the agent and/or retard the evaporation of the propellant. Solvents useful in the disclosure include, for example, water, ethanol and glycols. Any combination of suitable solvents can be use, optionally combined with preservatives, antioxidants, and/or other aerosol components.

An aerosol formulation can also be a dispersion or suspension. A suspension aerosol formulation can comprise a suspension of an agent or combination of agents of the instant disclosure, e.g., a neurological disorder associated biomarkers' inhibitors, and a dispersing agent. Dispersing agents useful in the disclosure include, for example, sorbitan trioleate, oleyl alcohol, oleic acid, lecithin and corn oil. A suspension aerosol formulation can also include lubricants, preservatives, antioxidant, and/or other aerosol components.

An aerosol formulation can similarly be formulated as an emulsion. An emulsion aerosol formulation can include, for example, an alcohol such as ethanol, a surfactant, water and a propellant, as well as an agent or combination of agents of the disclosure, e.g., a neurological disorder associated biomarkers' inhibitors. The surfactant used can be nonionic, anionic or cationic. One example of an emulsion aerosol formulation comprises, for example, ethanol, surfactant, water and propellant. Another example of an emulsion aerosol formulation comprises, for example, vegetable oil, glyceryl monostearate and propane.

The compounds of the disclosure can be formulated for administration as suppositories. A low melting wax, such as a mixture of triglycerides, fatty acid glycerides, Witepsol S55 (trademark of Dynamite Nobel Chemical, Germany), or cocoa butter is first melted and the active component is dispersed homogeneously, for example, by stirring. The molten homogeneous mixture is then poured into convenient sized molds, allowed to cool, and to solidify.

The compounds of the disclosure can be formulated for vaginal administration. Pessaries, tampons, creams, gels, pastes, foams or sprays containing in addition to the active ingredient such carriers as are known in the art to be appropriate.

It is envisioned additionally, that the compounds of the disclosure can be attached releasably to biocompatible polymers for use in sustained release formulations on, in or attached to inserts for topical, intraocular, periocular, or systemic administration. The controlled release from a biocompatible polymer can be utilized with a water soluble polymer to form an instillable formulation, as well. The controlled release from a biocompatible polymer, such as for example, PLGA microspheres or nanospheres, can be utilized in a formulation suitable for intra ocular implantation or injection for sustained release administration, as well any suitable biodegradable and biocompatible polymer can be used.

In one aspect of the disclosure, the subject's carrier status of any of the genetic variation risk variants described herein, or genetic variants identified via other analysis methods within the genes or regulatory loci that are identified by the CNVs described herein, can be used to help determine whether a particular treatment modality for a neurological disorder, such as any one of the above, or a combination thereof, should be administered. The present disclosure also relates to methods of monitoring progress or effectiveness of a treatment option for a neurological disorder. The treatment option can include any of the above mentioned treatment options commonly used. This can be done based on the outcome of determination of the presence of a particular genetic variation risk variant in the individual, or by monitoring expression of genes that are associated with the variants of the present disclosure. Expression levels and/or mRNA levels can thus be determined before and during treatment to monitor its effectiveness. Alternatively, or concomitantly, the status with respect to a genetic variation, and or genotype and/or haplotype status of at least one risk variant for a neurological disorder presented herein can determined before and during treatment to monitor its effectiveness. It can also be appreciated by those skilled in the art that aberrant expression levels of a gene impacted by a CNV or other mutations found as a consequence of targeted sequencing of the CNV-identified gene can be assayed or diagnostically tested for by measuring the polypeptide expression level of said aberrantly expressed gene. In another embodiment, aberrant expression levels of a gene may result from a CNV impacting a DNA sequence (e.g., transcription factor binding site) that regulates a gene who's aberrant expression level is involved in or causes a developmental disorder, or other mutations found as a consequence of targeted sequencing of the CNV-identified gene regulatory sequence, can be assayed or diagnostically tested for by measuring the polypeptide expression level of the gene involved in or causative of a developmental disorder. In some embodiments, a specific CNV mutation within a gene, or other specific mutations found upon targeted sequencing of a CNV-identified gene found to be involved in or causative of a developmental disorder, may cause an aberrant structural change in the expressed polypeptide that results from said gene mutations and the altered polypeptide structure(s) can be assayed via various methods know to those skilled in the art.

Alternatively, biological networks or metabolic pathways related to the genes within, or associated with, the genetic variations described herein can be monitored by determining mRNA and/or polypeptide levels. This can be done for example, by monitoring expression levels of polypeptides for several genes belonging to the network and/or pathway in nucleic acid samples taken before and during treatment. Alternatively, metabolites belonging to the biological network or metabolic pathway can be determined before and during treatment. Effectiveness of the treatment is determined by comparing observed changes in expression levels/ metabolite levels during treatment to corresponding data from healthy subjects.

In a further aspect, the genetic variations described herein and/or those subsequently found (e.g., via other genetic analysis methods such as sequencing) via targeted analysis of those genes initially identified by the genetic variations described herein, can be used to increase power and effectiveness of clinical trials. Thus, individuals who are carriers of at least one at-risk genetic variation can be more likely to respond to a particular treatment modality for a neurological disorder. In some embodiments, individuals who carry at-risk variants for gene(s) in a pathway and/or metabolic network for which a particular treatment is targeting are more likely to be responders to the treatment. In some embodiments, individuals who carry at-risk variants for a gene, which expression and/or function is altered by the at-risk variant, are more likely to be responders to a treatment modality targeting that gene, its expression or its gene product. This application can improve the safety of clinical trials, but can also enhance the chance that a clinical trial can demonstrate statistically significant efficacy, which can be limited to a certain sub-group of the population. Thus, one possible outcome of such a trial is that carriers of certain genetic variants are statistically significant and likely to show positive response to the therapeutic agent. Further, one or more of the genetic variations employed during clinical trials for a given therapeutic agent can be used in a companion diagnostic test that is administered to the patient prior to administration of the therapeutic agent to determine if the patient is likely to have favorable response to the therapeutic agent.

In a further aspect, the genetic variations described herein can be used for targeting the selection of pharmaceutical agents for specific individuals. The pharmaceutical agent can be any of the agents described in the above. Personalized selection of treatment modalities, lifestyle changes or combination of the two, can be realized by the utilization of the at-risk genetic variations or surrogate markers in linkage disequilibrium with the genetic variations. Thus, the knowledge of an individual's status for particular genetic variations can be useful for selection of treatment options, for example, for treatments that target genes or gene products affected by one or more of the genetic variations. Certain combinations of variants, including those described herein, but also combinations with other risk variants for a neurological disorder, can be suitable for one selection of treatment options, while other variant combinations can target other treatment options. Such combinations of variants can include one variant, two variants, three variants, or four or more variants, as needed to determine with clinically reliable accuracy the selection of treatment module.

Animal and Cell Models of Neurological disorders

Also provided herein are engineered cells that can harbor one or more polymorphism described herein, for example, one or more genetic variations associated with a neurological disorder, for example, a SNP or CNV. Such cells can be useful for studying the effect of a polymorphism on physiological function, and for identifying and/or evaluating potential therapeutic agents Methods are known in the art for generating cells, for example, by homologous recombination between the endogenous gene and an exogenous DNA molecule introduced into a cell, for example, a cell of an animal. In some cases, cells can be used to generate transgenic animals using methods known in the art.

The cells are preferably mammalian cells in which an endogenous gene has been altered to include a genetic variation as described herein. Techniques such as targeted homologous recombination, can be used to insert the heterologous DNA as described in, e.g., Chappel, U.S. Pat. No. 5,272,071; WO 91/06667. In another embodiment induced pluripotent stem cells with specific disease-causing or disease-associated mutations (such as CNVs and SNVs) can be used for disease modeling and drug discovery, for example, as described in Grskovic et al. (2011) Nat. Rev. Drug. Discov. 10(12):915-29.

PD is not known to occur naturally in any species other than humans, although animal models which show some features of the disease are used in research. The appearance of parkinsonian symptoms in a group of drug addicts in the early 1980s who consumed a contaminated batch of the synthetic opiate MPPP led to the discovery of the chemical MPTP as an agent that causes a parkinsonian syndrome in non-human primates as well as in humans. Other predominant toxin-based models employ the insecticide rotenone, the herbicide paraquat and the fungicide maneb. Models based on toxins are most commonly used in primates. Transgenic rodent models that replicate various aspects of PD have been developed.

Pharmaceutical compositions suitable for use in the present disclosure include compositions wherein the active ingredients are present in an effective amount, i.e., in an amount effective to achieve therapeutic and/or prophylactic benefit in a host with at least one a neurological disorder associated symptom. The actual amount effective for a particular application can depend on the condition or conditions being treated, the condition of the subject, the formulation, and the route of administration, as well as other factors known to those of skill in the art. Determination of an effective amount of a neurological disorder associated biomarkers' inhibitors is well within the capabilities of those skilled in the art, in light of the disclosure herein, and can be determined using routine optimization techniques.

The effective amount for use in humans can be determined from animal models. For example, a dose for humans can be formulated to achieve circulating, liver, topical and/or gastrointestinal concentrations that have been found to be effective in animals. One skilled in the art can determine the effective amount for human use, especially in light of the animal model experimental data described herein. Based on animal data, and other types of similar data, those skilled in the art can determine the effective amounts of compositions of the present disclosure appropriate for humans.

The effective amount when referring to an agent or combination of agents of the disclosure can generally mean the dose ranges, modes of administration, formulations, etc., that have been recommended or approved by any of the various regulatory or advisory organizations in the medical or pharmaceutical arts (e.g., FDA, AMA) or by the manufacturer or supplier.

Further, appropriate doses for a neurological disorder's associated biomarkers' inhibitors can be determined based on in vitro experimental results. For example, the in vitro potency of an agent in inhibiting a neurological disorder's associated biomarkers' components, provides information useful in the development of effective in vivo dosages to achieve similar biological effects. In some embodiments, administration of agents of the present disclosure can be intermittent, for example, administration once every two days, every three days, every five days, once a week, once or twice a month, and the like. In some embodiments, the amount, forms, and/or amounts of the different forms can be varied at different times of administration.

A person of skill in the art would be able to monitor in a subject the effect of administration of a particular agent. Other techniques would be apparent to one of skill in the art, wherein the active ingredients are present in an effective amount, for example, in an amount effective to achieve therapeutic and/or prophylactic benefit in a host with at least one a neurological disorder associated symptom. The actual amount effective for a particular application can depend on the condition or conditions being treated, the condition of the subject, the formulation, and the route of administration, as well as other factors known to those of skill in the art. Determination of an effective amount of a neurological disorder's associated biomarkers' inhibitors is well within the capabilities of those skilled in the art, in light of the disclosure herein, and can be determined using routine optimization techniques.

Further, appropriate doses for a neurological disorder's associated biomarkers' inhibitors can be determined based on in vitro experimental results. For example, the in vitro potency of an agent in inhibiting a neurological disorder associated biomarkers' components can provide information useful in the development of effective in vivo dosages to achieve similar biological effects.

Kits

Kits useful in the methods of the disclosure comprise components useful in any of the methods described herein, including for example, primers for nucleic acid amplification, hybridization probes for detecting genetic variation, or other marker detection, restriction enzymes, nucleic acid probes, optionally labeled with suitable labels, allele-specific oligonucleotides, antibodies that bind to an altered polypeptide encoded by a nucleic acid of the disclosure as described herein or to a wild type polypeptide encoded by a nucleic acid of the disclosure as described herein, means for amplification of genetic variations or fragments thereof, means for analyzing the nucleic acid sequence of nucleic acids comprising genetic variations as described herein, means for analyzing the amino acid sequence of a polypeptide encoded by a genetic variation, or a nucleic acid associated with a genetic variation, etc. The kits can for example, include necessary buffers, nucleic acid primers for amplifying nucleic acids, and reagents for allele-specific detection of the fragments amplified using such primers and necessary enzymes (e.g., DNA polymerase). Additionally, kits can provide reagents for assays to be used in combination with the methods of the present disclosure, for example, reagents for use with other screening assays for a neurological disorder.

In some embodiments, the disclosure pertains to a kit for assaying a nucleic acid sample from a subject to detect the presence of a genetic variation, wherein the kit comprises reagents necessary for selectively detecting at least one particular genetic variation in the genome of the individual. In some embodiments, the disclosure pertains to a kit for assaying a nucleic acid sample from a subject to detect the presence of at least particular allele of at least one polymorphism associated with a genetic variation in the genome of the subject. In some embodiments, the reagents comprise at least one contiguous oligonucleotide that hybridizes to a fragment of the genome of the individual comprising at least genetic variation. In some embodiments, the reagents comprise at least one pair of oligonucleotides that hybridize to opposite strands of a genomic segment obtained from a subject, wherein each oligonucleotide primer pair is designed to selectively amplify a fragment of the genome of the individual that includes at least one genetic variation, or a fragment of a genetic variation. Such oligonucleotides or nucleic acids can be designed using the methods described herein. In some embodiments, the kit comprises one or more labeled nucleic acids capable of allele-specific detection of one or more specific polymorphic markers or haplotypes with a genetic variation, and reagents for detection of the label. In some embodiments, a kit for detecting SNP markers can comprise a detection oligonucleotide probe, that hybridizes to a segment of template DNA containing a SNP polymorphisms to be detected, an enhancer oligonucleotide probe, detection probe, primer and/or an endonuclease, for example, as described by Kutyavin et al. (Nucleic Acid Res. 34:e128 (2006)).

In some embodiments, the DNA template is amplified by any means of the present disclosure, prior to assessment for the presence of specific genetic variations as described herein. Standard methods well known to the skilled person for performing these methods can be utilized, and are within scope of the disclosure. In one such embodiment, reagents for performing these methods can be included in the reagent kit.

In a further aspect of the present disclosure, a pharmaceutical pack (kit) is provided, the pack comprising a therapeutic agent and a set of instructions for administration of the therapeutic agent to humans screened for one or more variants of the present disclosure, as disclosed herein. The therapeutic agent can be a small molecule drug, an antibody, a peptide, an antisense or RNAi molecule, or other therapeutic molecules as described herein. In some embodiments, an individual identified as a carrier of at least one variant of the present disclosure is instructed to take a prescribed dose of the therapeutic agent. In one such embodiment, an individual identified as a carrier of at least one variant of the present disclosure is instructed to take a prescribed dose of the therapeutic agent. In some embodiments, an individual identified as a non-carrier of at least one variant of the present disclosure is instructed to take a prescribed dose of the therapeutic agent.

Also provided herein are articles of manufacture, comprising a probe that hybridizes with a region of human chromosome as described herein and can be used to detect a polymorphism described herein. For example, any of the probes for detecting polymorphisms described herein can be combined with packaging material to generate articles of manufacture or kits. The kit can include one or more other elements including: instructions for use; and other reagents such as a label or an agent useful for attaching a label to the probe. Instructions for use can include instructions for screening applications of the probe for making a diagnosis, prognosis, or theranosis to a neurological disorder in a method described herein. Other instructions can include instructions for attaching a label to the probe, instructions for performing in situ analysis with the probe, and/or instructions for obtaining a nucleic acid sample to be analyzed from a subject. In some cases, the kit can include a labeled probe that hybridizes to a region of human chromosome as described herein.

The kit can also include one or more additional reference or control probes that hybridize to the same chromosome or another chromosome or portion thereof that can have an abnormality associated with a particular endophenotype. A kit that includes additional probes can further include labels, e.g., one or more of the same or different labels for the probes. In other embodiments, the additional probe or probes provided with the kit can be a labeled probe or probes. When the kit further includes one or more additional probe or probes, the kit can further provide instructions for the use of the additional probe or probes. Kits for use in self-testing can also be provided. Such test kits can include devices and instructions that a subject can use to obtain a nucleic acid sample (e.g., buccal cells, blood) without the aid of a health care provider. For example, buccal cells can be obtained using a buccal swab or brush, or using mouthwash.

Kits as provided herein can also include a mailer (e.g., a postage paid envelope or mailing pack) that can be used to return the nucleic acid sample for analysis, e.g., to a laboratory. The kit can include one or more containers for the nucleic acid sample, or the nucleic acid sample can be in a standard blood collection vial. The kit can also include one or more of an informed consent form, a test requisition form, and instructions on how to use the kit in a method described herein. Methods for using such kits are also included herein. One or more of the forms (e.g., the test requisition form) and the container holding the nucleic acid sample can be coded, for example, with a bar code for identifying the subject who provided the nucleic acid sample.

In some embodiments, an in vitro screening test can comprise one or more devices, tools, and equipment configured to collect a nucleic acid sample from an individual. In some embodiments of an in vitro screening test, tools to collect a nucleic acid sample can include one or more of a swab, a scalpel, a syringe, a scraper, a container, and other devices and reagents designed to facilitate the collection, storage, and transport of a nucleic acid sample. In some embodiments, an in vitro screening test can include reagents or solutions for collecting, stabilizing, storing, and processing a nucleic acid sample.

Such reagents and solutions for nucleotide collecting, stabilizing, storing, and processing are well known by those of skill in the art and can be indicated by specific methods used by an in vitro screening test as described herein. In some embodiments, an in vitro screening test as disclosed herein, can comprise a microarray apparatus and reagents, a flow cell apparatus and reagents, a multiplex nucleotide sequencer and reagents, and additional hardware and software necessary to assay a nucleic acid sample for certain genetic markers and to detect and visualize certain genetic markers.

The present disclosure further relates to kits for using antibodies in the methods described herein. This includes, but is not limited to, kits for detecting the presence of a variant polypeptide in a test nucleic acid sample. One preferred embodiment comprises antibodies such as a labeled or labelable antibody and a compound or agent for detecting variant polypeptides in a nucleic acid sample, means for determining the amount or the presence and/or absence of variant polypeptide in the nucleic acid sample, and means for comparing the amount of variant polypeptide in the nucleic acid sample with a standard, as well as instructions for use of the kit. In certain embodiments, the kit further comprises a set of instructions for using the reagents comprising the kit.

Unless otherwise explained, all technical and scientific terms used herein have the same meaning as commonly understood by one of ordinary skill in the art to which this disclosure belongs. The following references contain embodiments of the methods and compositions that can be used herein: The Merck Manual of Diagnosis and Therapy, 18th Edition, published by Merck Research Laboratories, 2006 (ISBN 0-911910-18-2); Benjamin Lewin, Genes IX, published by Jones & Bartlett Publishing, 2007 (ISBN-13: 9780763740634); Kendrew et al. (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8).

Standard procedures of the present disclosure are described, e.g., in Maniatis et al., Molecular Cloning: A Laboratory Manual, Cold Spring Harbor Laboratory Press, Cold Spring Harbor, N.Y., USA (1982); Sambrook et al., Molecular Cloning: A Laboratory Manual (2 ed.), Cold Spring Harbor Laboratory Press, Cold Spring Harbor, N.Y., USA (1989); Davis et al., Basic Methods in Molecular Biology, Elsevier Science Publishing, Inc., New York, USA (1986); or Methods in Enzymology: Guide to Molecular Cloning Techniques Vol. 152, S. L. Berger and A. R. Kimmerl (eds.), Academic Press Inc., San Diego, USA (1987)). Current Protocols in Molecular Biology (CPMB) (Fred M. Ausubel, et al. ed., John Wiley and Sons, Inc.), Current Protocols in Protein Science (CPPS) (John E. Coligan, et. al., ed., John Wiley and Sons, Inc.), Current Protocols in Immunology (CPI) (John E. Coligan, et. al., ed. John Wiley and Sons, Inc.), Current Protocols in Cell Biology (CPCB) (Juan S. Bonifacino et. al. ed., John Wiley and Sons, Inc.), Culture of Animal Cells: A Manual of Basic Technique by R. Ian Freshney, Publisher: Wiley-Liss; 5th edition (2005), and Animal Cell Culture Methods (Methods in Cell Biology, Vol. 57, Jennie P. Mather and David Barnes editors, Academic Press, 1st edition, 1998), which are all incorporated by reference herein in their entireties.

It should be understood that the following examples should not be construed as being limiting to the particular methodology, protocols, and compositions, etc., described herein and, as such, can vary. The following terms used herein is for the purpose of describing particular embodiments only, and is not intended to limit the scope of the embodiments disclosed herein.

Disclosed herein are molecules, materials, compositions, and components that can be used for, can be used in conjunction with, can be used in preparation for, or are products of methods and compositions disclosed herein. It is understood that when combinations, subsets, interactions, groups, etc. of these materials are disclosed and while specific reference of each various individual and collective combinations and permutation of these molecules and compounds cannot be explicitly disclosed, each is specifically contemplated and described herein. For example, if a nucleotide or nucleic acid is disclosed and discussed and a number of modifications that can be made to a number of molecules including the nucleotide or nucleic acid are discussed, each and every combination and permutation of nucleotide or nucleic acid and the modifications that are possible are specifically contemplated unless specifically indicated to the contrary. This concept applies to all aspects of this application including, but not limited to, steps in methods of making and using the disclosed molecules and compositions. Thus, if there are a variety of additional steps that can be performed it is understood that each of these additional steps can be performed with any specific embodiment or combination of embodiments of the disclosed methods, and that each such combination is specifically contemplated and should be considered disclosed.

Those skilled in the art can recognize, or be able to ascertain using no more than routine experimentation, many equivalents to the specific embodiments of the method and compositions described herein. Such equivalents are intended to be encompassed by the following claims.

It is understood that the disclosed methods and compositions are not limited to the particular methodology, protocols, and reagents described as these can vary. It is also to be understood that the terminology used herein is for the purpose of describing particular embodiments only, and is not intended to limit the scope of the present disclosure which can be limited only by the appended claims.

Unless defined otherwise, all technical and scientific terms used herein have the meanings that would be commonly understood by one of skill in the art in the context of the present specification.

It should be noted that as used herein and in the appended claims, the singular forms "a," "an," and "the" include plural reference unless the context clearly dictates otherwise. Thus, for example, reference to "a nucleotide" includes a plurality of such nucleotides; reference to "the nucleotide" is a reference to one or more nucleotides and equivalents thereof known to those skilled in the art, and so forth.

The term "and/or" shall in the present context be understood to indicate that either or both of the items connected by it are involved. While preferred embodiments of the present disclosure have been shown and described herein, it can be obvious to those skilled in the art that such embodiments are provided by way of example only. Numerous variations, changes, and substitutions can now occur to those skilled in the art without departing from the disclosure. It should be understood that various alternatives to the embodiments of the disclosure described herein can be employed in practicing the disclosure. It is intended that the following claims define the scope of the disclosure and that methods and structures within the scope of these claims and their equivalents be covered thereby.

EXAMPLES

Example 1

In the present study, data was generated on the basis of a comparison of copy number variants (CNVs) identified in 2 cohorts:
1. 1,005 Normal individuals (Normal Variation Engine—NVE);
2. 468 Parkinson's Disease (PD) cases (samples obtained from the The Parkinson's Institute and Clinical Center (PI), Sunnyvale, Calif. 94085, USA).

Genomic DNA samples from individuals within the Normal cohort (NVE 'test' subjects) and from the PD cohort (PD 'test' subjects) were hybridized against a single, sex-matched reference individual as follows. Reference DNA samples were labeled with Cy5 and test subject DNA samples were labeled with Cy3. After labeling, samples were combined and co-hybridized to Agilent 1M feature oligonucleotide microarrays, design ID 021529 (Agilent Product Number G4447A) using standard conditions (array Comparative Genomic Hybridization—aCGH). Post-hybridization, arrays were scanned at 2 µm resolution, using Agilent's DNA microarray scanner, generating tiff images for later analysis. All tiff images were analyzed using Agilent Feature Extraction (FE) software, with the following settings:
Human Genome Freeze:hg18:NCBI36:Mar2006
FE version: 10.7.3.1
Grid/design file: 021529_D_F_20091001
Protocol: CGH_107_Sep09

This procedure generates a variety of output files, one of which is a text-tab delimited file, containing ~1,000,000 rows of data, each corresponding to a specific feature on the array. This *.txt file was used to perform CNV calling using DNAcopy, an open source software package implemented in R via BioConductor (http://www.bioconductor.org/packages/release/bioc/html/DNAcopy.html). Losses or gains were determined according to a threshold log 2 ratio, which was set at −/+0.35. In other words, all losses with a log 2 ratio value <=−0.35 were counted, as were all gains with a log 2 ratio>=+0.35. All log 2 ratio values were determined according to Cy3/Cy5 (Test/Reference). A minimum probe threshold for CNV-calling was set at 2 (2 consecutive probes were sufficient to call a CNV). A CNV list was thus generated for each individual in the 2 cohorts.

There were a total of 162,316 CNVs in the NVE cohort of 1,005 individuals (an average of 162 CNVs per individual). Using custom scripts, these CNVs (many of which appeared in multiple individuals) were 'merged' into a master list (NVE-master) of non-redundant CNV-subregions, according to the presence or absence of the CNV-subregion in individuals within the cohort. Using this approach, the NVE-master list has 14,693 distinct CNV-subregions, some of which are uniquely present in a single individual and some of which are present in multiple individuals. For example, consider 3 individuals within the NVE cohort with the following hypothetical CNVs:
A. Chr1:1-100,000;
B. Chr1:10,001-100,000;
C. Chr1:1-89,999;

In the master list, these would be merged into 3 distinct CNV subregions, as follows:

| CNV-subregion 1 | Chr1: 1-10,000 | Patients A, C |
| CNV-subregion 2 | Chr1: 10,001-89,999 | Patients A, B, C |
| CNV-subregion 3 | Chr90,000: 1-100,000 | Patients A, B |

There were a total of 76,011 CNVs in the PD cohort of 468 individuals (an average of 162 CNVs per individual). Using custom scripts, these CNVs (many of which appeared in multiple individuals) were 'merged' into a master list (PD-master) of non-redundant CNV-subregions, according to the presence or absence of the CNV-subregion in individuals within the cohort. Using this approach, the PD-master list has 9,162 distinct CNV-subregions, some of which are uniquely present in a single individual and some of which are present in multiple individuals.

CNV-subregions of interest were obtained after:
1. Annotation using custom designed scripts in order to attach to each CNV region relevant information regarding overlap with known genes and exons;
2. A calculation of the odds ratio (OR) for each CNV-subregion, according to the following formula:

$$OR=(PD/(468-PD))/(NVE/(1005-NVE))$$

where: PD=number of PD individuals with CNV-subregion of interest and NVE=number of NVE individuals with CNV-subregion of interest.

An illustrative example is the CNV subregion chr14: 31189082-31191639, which is found in 2 individuals in the NVE cohort and 15 individuals in the PD cohort.

The OR is: $(15/(468-15))/(2/(1005-2))=16.61$

By convention, if NVE=0, it is set to 1, in order to avoid dealing with infinities. This has the effect of artificially lowering OR values in cases where none are seen in the NVE.

Each of the CNV-subregions/genes fulfills one of the following criteria:
1. CNV-subregion overlaps a known gene (whether the exonic, intronic part of the gene or both) and is associated with an OR of >6;
2. CNV-subregion does not overlap a known gene (e.g., is non-genic or intergenic) and is associated with an OR of >10;
3. The OR associated with the sum of PD cases and the sum of NVE cases affecting the same gene (including distinct CNV-subregions) is >6;

It can be appreciated by those skilled in the art that the number of PD candidate CNV-subregions, irrespective category (genic or non-genic), may increase or decrease as additional PD cohorts are analyzed.

The CNV regions/subregions are relevant to a set of 15 genes, which represent rediscovery/replication of previously identified genes including: ATRNL1, C20orf26, CNTNAP2, DCC, DPP6, FGF12, F1133630, GADL1, LRRIQ3, MGAT4C, MTHFD1L, PLCL1, RNF144B, SENP5, snd ZC3H6.

Example 2

The study also included of a comparison of copy number variants (CNVs) identified in 2 cohorts: 1,005 Normal individuals (Normal Variation Engine—NVE) and 87 PD cases (DNA samples obtained from Coriell Institute).

Genomic DNA samples from individuals within the Normal and the PD cohorts ('test' subjects) were hybridized against a single, sex-matched reference individual as follows. Reference DNA samples were labeled with Cy5 and Test subject DNA samples were labeled with Cy3. After labeling, samples were combined and co-hybridized to Agilent 1M feature oligonucleotide microarrays, design ID 021529 (Agilent Product Number G4447A) using standard conditions (array Comparative Genomic Hybridization—aCGH). Post-hybridization, arrays were scanned at 2 μm resolution, using Agilent's DNA microarray scanner, generating tiff images for later analysis. Tiff images were analyzed using Agilent Feature Extraction (FE) software, with the following settings:
Human Genome Freeze:hg18:NCBI36:Mar2006
FE version: 10.7.3.1
Grid/design file: 021529_D_F_20091001
Protocol: CGH_107_Sep09

This procedure generates a variety of output files, one of which is a text-tab delimited file, containing ~1,000,000 rows of data, each corresponding to a specific feature on the array. This *.txt file was used to perform CNV calling using DNAcopy, an open source software package implemented in R via BioConductor (http://www.bioconductor.org/packages/release/bioc/html/DNAcopy.html). Losses or gains were determined according to a threshold log 2 ratio, which was set at −/+0.35. In other words, all losses with a log 2 ratio value <=−0.35 were counted, as were all gains with a log 2 ratio>=+0.35. Note that all log 2 ratio values were determined according to Cy3/Cy5 (Test/Reference). Thus, a negative log 2 ratio value refers to a loss in the Test relative to the Reference and vice versa. A CNV list was thus generated for each individual in the 2 cohorts. All CNV lists from the 1,005 Normals were merged into one master list, containing a non-redundant list of all CNVs found in the Normal cohort (NVE-master). All CNVs from the 87 PD cases were merged into one master list, containing a non-redundant list of all CNVs found in the PD cohort (PD-master).

Direct comparisons were made between NVE-master and PD-master lists, so that only CNVs present in the PD-master AND absent in the NVE-master were classified as PD-unique (PD-unique list) and were always considered for further evaluation; CNVs present at substantially higher frequency in the PD cohort relative to the Normal cohort were sometimes considered for further evaluation (PD-specific list).

The PD-unique and PD-specific lists of CNVs were annotated using custom designed scripts in order to attach to each CNV region relevant information regarding overlap with known genes, exons, miRNA and CNVs from publicly available databases.

PD-specific and PD-unique CNVs, determined by interpretation of PD cohort CNVs against CNVs detected in 1,005 Normal genomes, are visually inspected to verify CNV calls. While the PD-unique CNVs were of most interest, in a small number of instances, visual inspection of the CGH data or detailed analysis of the CNV frequencies results in identification of CNVs that occur in one or more PD cases but only 1-3 times in the Normals and thus are statistically significant (e.g., with odds ratios of approximately 4-40)—PD-specific CNVs.

PD-specific/unique CNVs are then filtered on the number of PD cases impacted by the CNV and whether the CNV is intronic, exonic, or both. They are classified as Class A or Class B as follows:
Class A≥2 PD cases CNV impacts exons, introns, or both
Class B 1 PD case CNV impacts exons and gene function is neurological and/or has role in PD pathology The statistical significance for Class A candidates is sufficient to consider them as causative of PD without consideration of gene function although such evidence is annotated as it provides another level of confidence that a PD candidate gene is causal of PD. Gene annotation is derived from four main sources:
1. http://genome.ucsc.edu/
2. Link out from the UCSC genome browser to NCBI resources: OMIM, PubMed, AceView
3. USPTO patent and application search http://www.uspto.gov/patents/process/search/
4. General internet search Further neurological and/or links to PD pathology can be established via pathway analysis of the genes, which may take into consideration binding interactions (e.g., via yeast 2-hybrid screen) and molecular events (e.g., kinase activity or other enzymatic processes) if such information is available for the gene(s) of interest (i.e., specified in the analysis). Both commercial (e.g., Ingenuity IGA software and GeneGo software) and open source software (e.g., Strings db) are available for such analyses. To assess connections to established PD biology, analyses can be performed for the set of candidate PD genes independently or against known causative PD genes (GBA, LRRK2, PARK2, PARK7, P1NK1, SNCA, VPS35) singly or as a group. For example, such analyses identified CERK as a PD candidate gene because, while it was found in only 1 of 87 PD cases, pathway analysis revealed its link to PD causative gene GBA (GBA protein glucocerebrosidase catalyzes breakdown of glycolipidglucosylceramide to ceramide and glucose and CERK protein ceramide kinase converts ceramide into ceramide-1-phosphate, a signaling molecule). In general, PD candidate genes distributed into 5 main categories: 1) neurotrophin gene product or gene candidate impacts a neurotrophin, 2) protein misfolding, aggregation, and/or role in ubiquitin pathway, 3) linked to known causative PD gene (e.g., binding partner), 4) linked to PD pathology by function (e.g., mitochondrial dysfunction, oxidative stress, or PD phenotypes such as dopaminergic neuronal loss), and 5) other (e.g., role in other diseases with no obvious neurological biology, such as cancer) or unknown gene function (e.g., limited or no gene information presently annotated for the PD-specific gene).

Some pathway analysis software also identifies whether the candidate gene is a drug target, which may be FDA-approved or in clinical trials. Such information can assist in the design of clinical trials (e.g., patient stratification for genetic subtypes) or be used to facilitate clinical trials that are in progress, thereby reducing the attrition rate (failure to receive FDA approval) and reducing the time and cost of drug development. If a candidate PD gene is identified as a known drug target of an FDA-approved therapeutic, the drug can be repurposed and approved for use in a new indication (e.g., a cancer or anti-inflammatory agent may be beneficial to PD patients as well). Those skilled in the art will recognize that Phase II and III failures may be rescued with additional clinical trial data that accounts for genetic subtypes, particularly when the drug fails for lack of efficacy. For example, if a drug is designed or established to target a particular gene defect (e.g., use of an RNAi therapeutic to decrease aberrant overexpression of the gene that is caused by a CNV or other type of genetic variant), it is expected that only PD patients with that particular genetic subtype will benefit from the targeted therapy.

It can be appreciated by those skilled in the art that the number of PD candidate genes, whether belonging to Class A or Class B, may increase or decrease when additional PD cohorts are analyzed for CNV-specific genes. For very rare CNVs (e.g., <0.1% frequency in the general population), only a single case may be observed in a given PD cohort (e.g., 100 cases) but further statistical significance or evidence for the gene can be established by: 1) CNV analysis of additional PD cohorts, 2) CNV analysis of additional Normal cohorts, 3) targeted gene sequencing of both PD and Normal cohorts, and 4) functional characterization of the PD candidate gene (e.g., in silico analysis of the predicted impact of the candidate mutation on the gene product, RNAi knockdown experiments, biochemical assays on PD patient tissue, gene expression analysis of induced pluripotent stem cells (iPSCs) created from the PD patient(s) harboring the candidate PD-causing genetic variant).

Example 3

FIG. 1 is an example of a copy number gain occurring in three PD cases that disrupts a gene wherein a CNV-subregion overlaps a known gene, and is associated with an OR of at least 6.

FIG. 1 represents an example of a CNV-subregion that overlaps a known gene, and is associated with an OR of at least 6. The CNV is a gain (log 2 ratio>0.35) and affects the gene MGAT4C on chromosome 12. The calculated odds ratio (OR) for this CNV-subregion is 6.48.

In the figure, five tracks of information are shown, from top to bottom: 1) RefSeq gene annotation showing the genome location α-axis) of genes demarcated in light gray (introns) and dark gray (exons) and with multiple entries depicted if multiple transcript variants are annotated that correspond to the gene; 2) size and genome location α-axis) for normal CNVs annotated for greater than 1,000 unaffected/normal individuals, with CNVs demarcated by dark gray bars and the y-axis corresponds to the number of individuals in the normal cohort found to have the CNV; 3) array CGH data (black dots correspond to the probes on the microarray) for a PD case with a CNV gain wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative to the baseline (log 2 ratio=0); 4) array CGH data (black dots correspond to the probes on the microarray) for a PD case with a CNV gain wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative to the baseline (log 2 ratio=0); 5) array CGH data (black dots correspond to the probes on the microarray) for a PD case with a CNV gain wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative to the baseline (log 2 ratio=0).

Example 4

Figure 2:
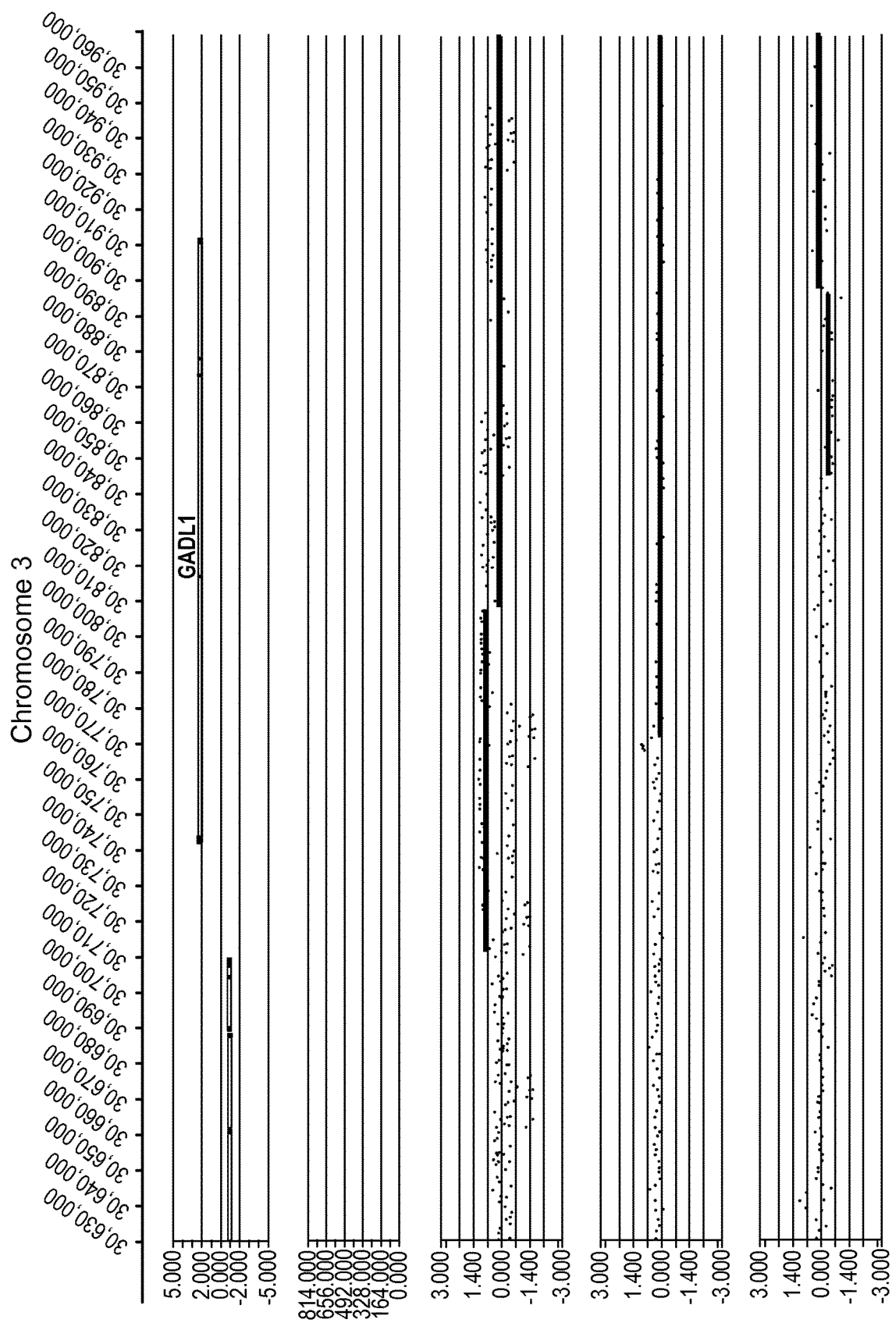
FIG. 2 is an example of a copy number gain occurring in two PD cases and a copy number loss occurring in one PD case that disrupts the GADL1 gene and represents an example of a CNV wherein the OR associated with the sum of PD cases and the sum of NVE cases affecting the same gene, including distinct CNV-subregions, is at least 6. The CNVs are a mixture of gains (log 2 ratio>0.35) and losses (log 2 ratio <−0.35) and affect the gene GADL1 on chromosome 3. The calculated odds ratio (OR) for this CNV-subregion is 6.48.

FIG. 2 is an example of a copy number gain occurring in two PD cases and a copy number loss occurring in one PD case that disrupts a gene with an OR associated with the sum of PD cases and the sum of NVE cases affecting the same gene, including distinct CNV-subregions, of at least 6. In the figure, four tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal individuals, with CNVs demarcated by dark gray bars and the y-axis corresponds to the number of individuals in the normal cohort found to have the CNV; 3) array CGH data (black dots correspond to the probes on the microarray) for a PD case with a CNV gain wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative the to baseline (log 2 ratio=0); 4) array CGH data (black dots correspond to the probes on the microarray) for a PD case with a CNV gain wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative the to baseline (log 2 ratio=0); 5) array CGH data (black dots correspond to the probes on the microarray) for a PD case with a CNV loss wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative the to baseline (log 2 ratio=0).

FIG. 2 represents an example of a CNV with an OR associated with the sum of PD cases and the sum of NVE cases affecting the same gene, including distinct CNV-subregions, is at least 6. The CNVs are a mixture of gains (log 2 ratio>0.35) and losses (log 2 ratio <−0.35) and affect the gene GADL1 on chromosome 3. The calculated odds ratio (OR) for this CNV-subregion is 6.48.

In the figure, three tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal individuals, with CNVs demarcated by dark gray bars and the y-axis corresponds to the number of individuals in the normal cohort found to have the CNV; 3) array CGH data (black dots correspond to the probes on the microarray) for a PD case with a CNV loss wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative to the baseline (log 2 ratio=0).

Example 5

Figure 3:
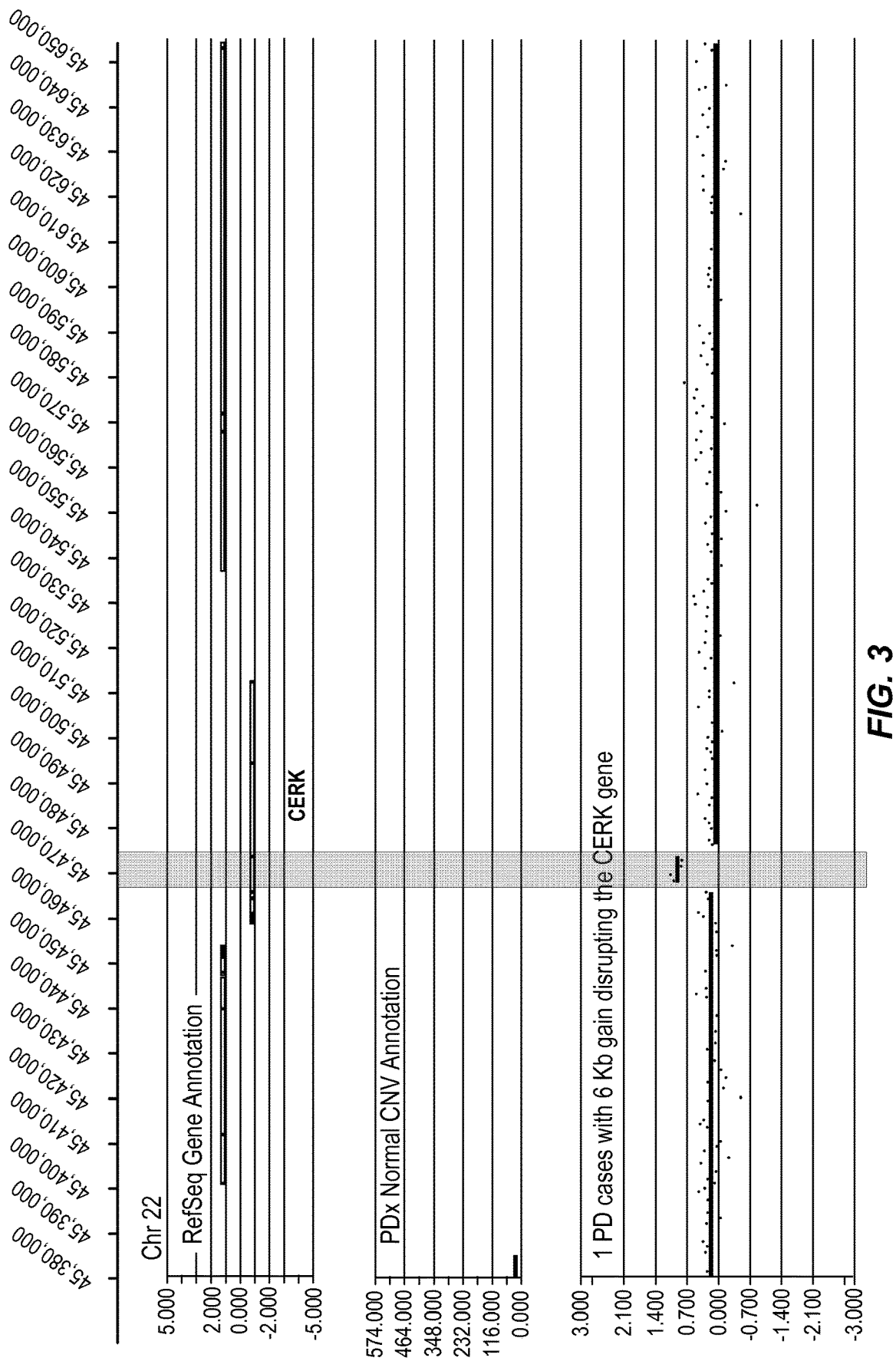
FIG. 3 is an example of a copy number gain occurring in one PD case that disrupts the CERK gene.

FIG. 3 is an example of a copy number gain occurring in one PD case that disrupts the CERK gene. The gain is not found in an unaffected/normal cohort of at least 1,000 individuals. In the figure, three tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal individuals, with CNVs demarcated by dark gray bars and the y-axis corresponds to the number of individuals in the normal cohort found to have the CNV; 3) array CGH data (black dots correspond to the probes on the microarray) for a PD case with a CNV gain wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative the to baseline (log 2 ratio=0).

Example 6

Figure 4:
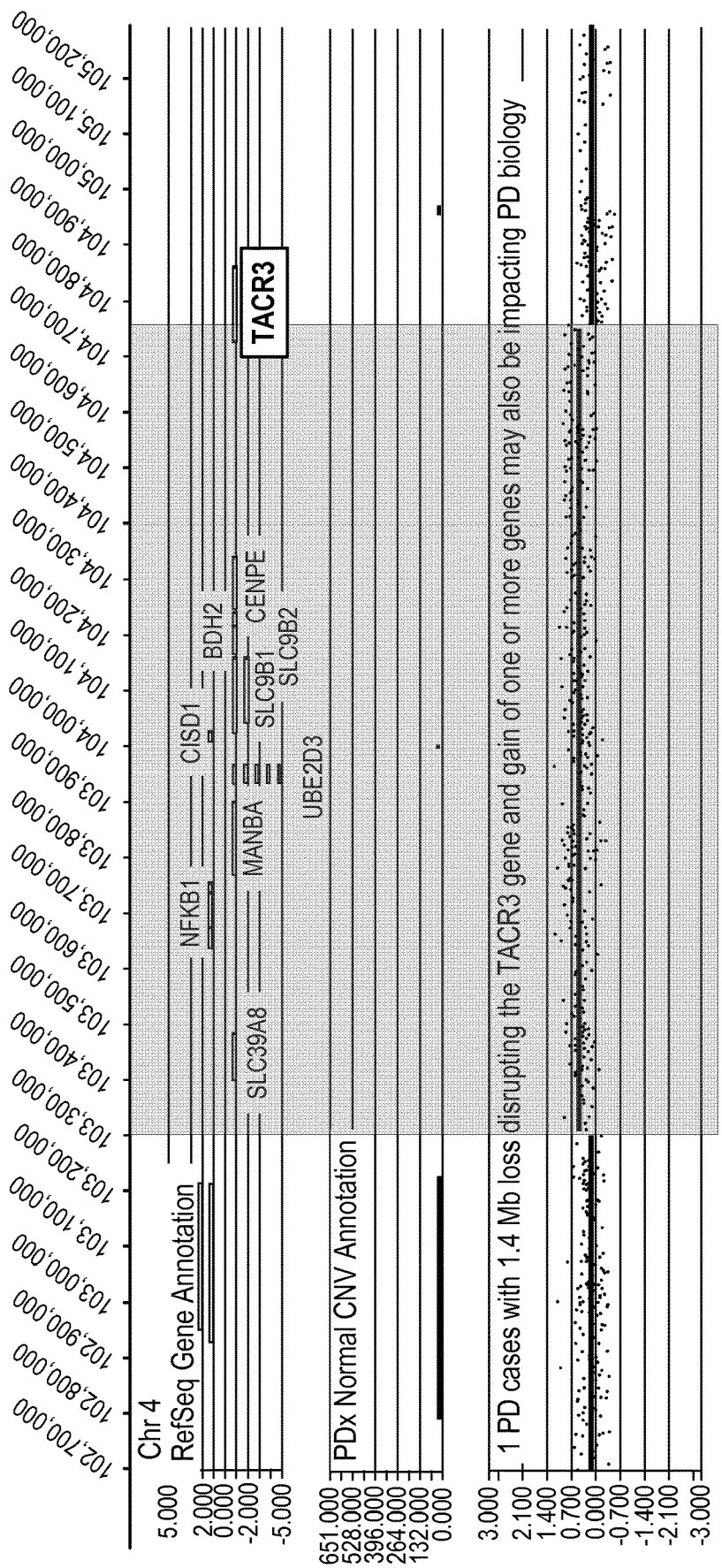
FIG. 4 is an example of a copy number gain occurring in one PD case that disrupts the TACR3 gene and confers a gain of one or more genes that may influence PD biology.

FIG. 4 is an example of a copy number gain occurring in one PD case that disrupts the TACR3 gene and confers a gain of one or more genes that may influence PD biology. The gain is not found in an unaffected/normal cohort of at least 1,000 individuals. In the figure, four tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal individuals, with CNVs demarcated by dark gray bars and the y-axis corresponds to the number of individuals in the normal cohort found to have the CNV; 3) array CGH data (black dots correspond to the probes on the microarray) for a PD case with a CNV loss wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative the to baseline (log 2 ratio=0); 4) array CGH data (black dots correspond to the probes on the microarray) for a second PD case with a CNV loss wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative the to baseline (log 2 ratio=0).

Example 7

Figure 5:
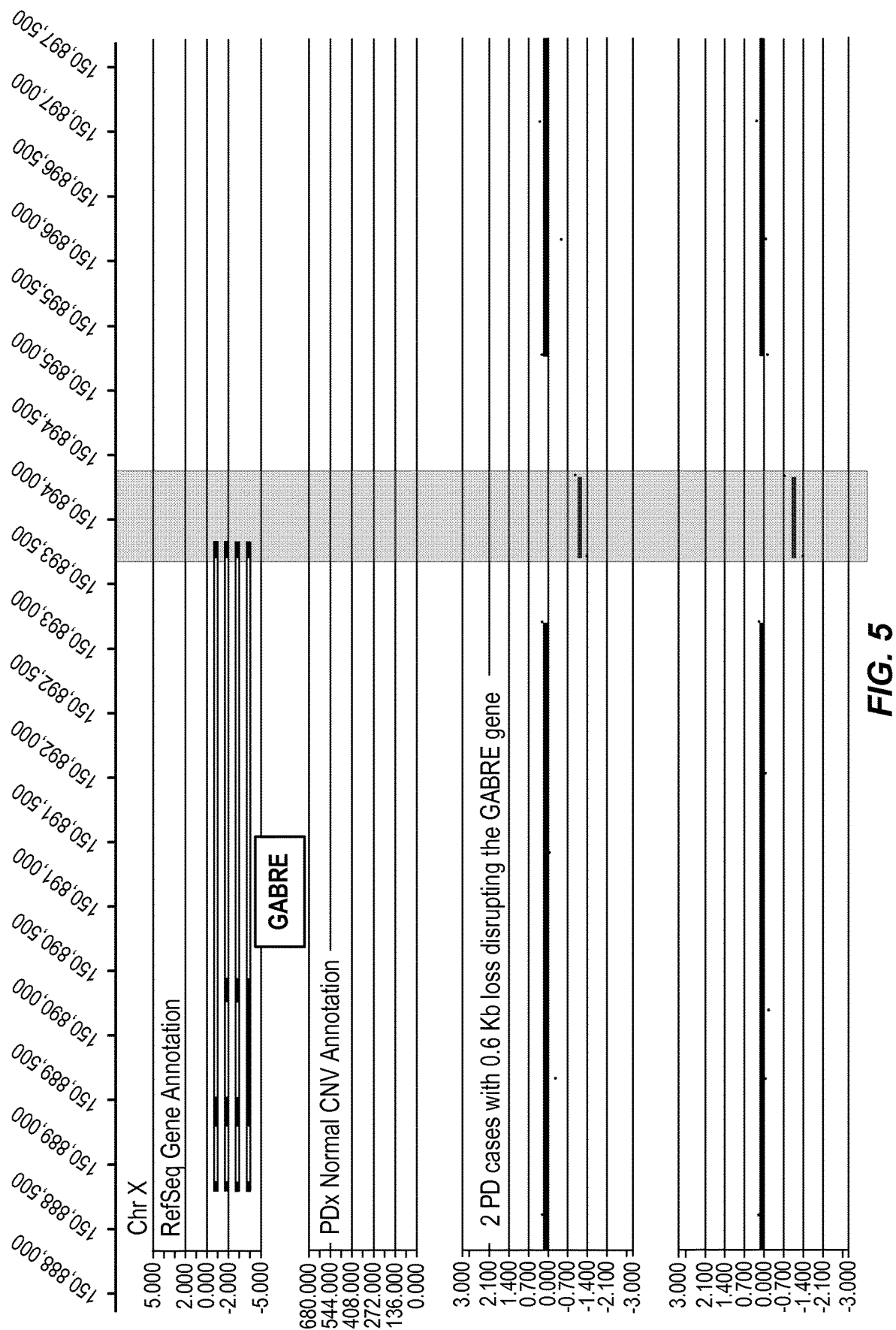
FIG. 5 is an example of a copy number loss occurring in two PD cases that disrupts the GABRE gene.

FIG. 5 is an example of a copy number loss occurring in two PD cases that disrupts the GABRE gene. The loss is not found in an unaffected/normal cohort of at least 1,000 individuals. In the figure, four tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal individuals, with CNVs demarcated by dark gray bars and the y-axis corresponds to the number of individuals in the normal cohort found to have the CNV; 3) array CGH data (black dots correspond to the probes on the microarray) for a PD case with a CNV loss wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative the to baseline (log 2 ratio=0); 4) array CGH data (black dots correspond to the probes on the microarray) for a second PD case with a CNV loss wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative the to baseline (log 2 ratio=0).

Example 8

Figure 6:
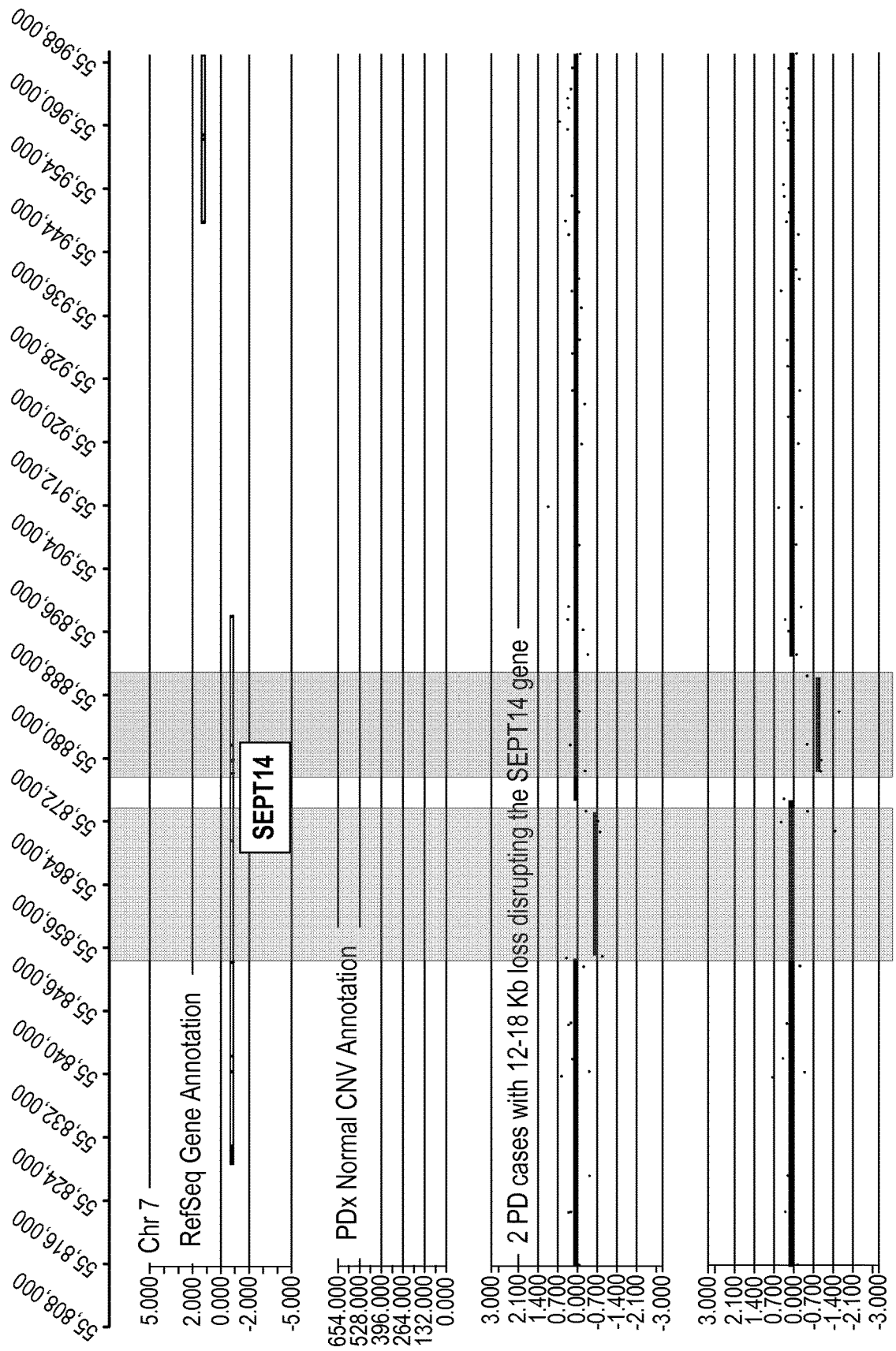
FIG. 6 is an example of two non-overlapping copy number losses, each occurring in one of two PD cases, which disrupt the SEPT14 gene.

FIG. 6 is an example of two non-overlapping copy number losses, each occurring in one of two PD cases that disrupt the SEPT14 gene. The losses are not found in an unaffected/normal cohort of at least 1,000 individuals. In the figure, four tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal individuals, with CNVs demarcated by dark gray bars and the y-axis corresponds to the number of individuals in the normal cohort found to have the CNV; 3) array CGH data (black dots correspond to the probes on the microarray) for a PD case with a CNV loss wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative the to baseline (log 2 ratio=0); 4) array CGH data (black dots correspond to the probes on the microarray) for a second PD case with a CNV loss wherein the y-axis is the log 2 ratio value of the test (PD case) and reference (healthy control) genomic DNAs and the x-axis corresponds to the genome location of the probes and CNVs, which are depicted as line segments shifted positively (copy number gain) or negatively (copy number loss) relative the to baseline (log 2 ratio=0).

Example 9

Description of Sequence Data

The sequence file Combined_patent_ST25.txt contains genomic sequence information for all CNVs listed in Table 1 as well as for the full genomic extent of the transcripts referred to in Table 4.

For example, row 51 of Table 1 contains information related to a CNV whose coordinates are chr 3:193371224-193374127 and was discovered as a 2,903 bp gain in patient 1016. The sequence for this CNV is found in Combined_patent_ST25.txt and is referred to as SEQ ID 18 (sequence truncated for brevity):

```
Sequence entry starts:
<210> 18
<211> 2904
<212> DNA
<213> Homo sapiens
<400> 18
tccatgtcct ctgttaagaa caaatgaaag gcaatgacac atagtttcta ttagcctttg     60
gttacaaaga ttcatcatac aaaatcaaaa aacatgattg cctttctagc caaccttcag    120

...............................................................
tagatttagg tctgaatttt aattcatttt cttttaaaaa caaactaatt aaaataatcc   2880
caaagctttt tattattttt tttt                                          2904

Sequence entry ends.
```

For an example of a transcript sequence, consider row 9 of Table 4 which relates to the gene FGF12. There are two transcripts reported for this gene and the first of these is dealt with on row 9: NM_021032. This transcript sequence is referred to as SEQ ID 391 and appears as such in Combined_patent_ST25.txt (sequence truncated for brevity):

```
Sequence entry starts:
<210> 391
<211> 269658
<212> DNA
<213> Homo sapiens
<400> 391
tgaataatct gtgctttaat ggaaaaatga aacattaatt tgtttagttt ctcatacaac      60

.................................................................
cccggagtct gggtaggggc gcggggcggg ggcagctgtt tccagctgcg gtgagagcaa  269640
ctcccggcca gcagcact                                                269658

Sequence entry ends.
```

SEQUENCE LISTING (1020 sequences)

SEQ ID NO: 1 - DNA, 8366 bp, Homo sapiens
caagaatttctaaaatagccctttttgaataattacaaagtaaacagttcttcaataccctgctatcaaagtatggactgactaaccaaaggcattgacatcacccaggagcgtgtcagaaatgtagaattttagccctgtcgccactgaatgagatcctgctttttacccaaatccccctaggtgataatgtgcacagatgcttgcaagccattgtctaatagaaaaacaacaccaccaaaatcactccatttccttaatttgggaattgtctatagtattttcagttatgtctgtgaagatatgaaattgtttggaatttgaggattggcttaaattatggttcacagcataactcaatgaaatatttagtgttctttttccacttgcatctagattagtagagatatgatgtttttaatgtttttttcattttaatgaattttggagatgattgaaattagttaatatcatagtgaataatccttgtcttgttaaactactattttaattatgcatgaaatgctgctatcatttatatgcattatgtaatgtattttgataattaggcagctaatatgtagcaaaacacctttatacctatcagtttgtcagttatgatgtcagtaatgatgttctagttgttatcaatggaagtaatccagtgtcaatggattgcttcttaatcgttatagtatttaattctctgtggcatatctcacttatttctccatttggaataactgtttcttcaatttctgttgcatttgtctttcccatatttgtggtttcaatcaagttattcattcctctgagcttcaattacccaatctataaaatgaagattactagtggtacttaattatagggttatcatgatgattatgtgagatagttatgtgaaacaaaaccttacctattgcattgtaataattgttctaaattgtaaatagatgatcatcattttctttttcttcatcatcaccgtcaacgtcattggtatttaagagagctttttaatcttcttatcatttacctcacctttttaaaacctttggtgatttcccataatatttaagataaatttattcctttatcttttacttatctatattaggttgattacttctactacaagtcatacaaaaattataactgctcatcataacaaagacaaaatatttagtttaattcactcttgttttacatctttctatgttgagagtttaaatcgttgattttagaacttttcttttttctgatatatactctacagctataaattaacctgtatgcagtgctttgaccacattttacacattttggtatgttgtattttcatttttatttagtccaaaatatttcctgatttttcctgtgatattttctttgatgcataagttattccaaaatgttatttaattcatttcagggatatttcaggtgtctcctttttattaatttccaatttagttttcgctatggtcagagaaaaactatggttttaatcctttttaactttattaaggcttgtttttggcatattttttattttgcagaaaattcatgtgcttaaaaagcaaagtgccttctgctcttgttattcttttaatgtcagttggatatttatttgattcttattcaatgtctgagattattgctgattttctttctactttttctatcaattactgagaatattttggaaatttccagctatttttggtgttgtgtttctttttttaatattgtcagattttcttcttgttttttgaaattgtagtttttgtacatatacatttacataaaaggtccctttactgacccttttatttttatgaaatgttcttttttgtctttattaaatctgcatgccaaactactttcagctctccaaatatctatcctctgtcatttatttcattttgctgcttatttttacattctgtatttttatcttgcaaatgacctttctggccttaaccttttttttaactcttgcttagcttttgtctaattgtgaatataacctccccttatacctaactactagaaattactcttttcttacaactggcatattctttaacttatcacagtttatttatatttattgcttcacttatttatccattattagccctcaaactcctttacagagaaactacatatttttttgtatttttagtacttagctgaggtagctaaaggaatagtttttaaattgagagatgagtaatatatttctctggagaaaggaatgtacagataaaatatgctttcttatactcttaaaaaagttttaacatgcaatatagatagtttatgagtacaataaaagatttctcccttatatttacaaaaatcacatgggtttcttatttaataataacccaaattctttcttctcccaaaatgaaattttatagtaagttgttttgttaattaagattttgtgtaagaaacagaaatcgtgcatgactaacaaacagaagaaaatgtattgttagcataaggtgttgctaacaatatgaaagggaagaataaatcatcaggttttcaataagcagaaagctttcattccaacagttttcagtcatgtgcattagttgacattcttaactgggcatgcctgctatactgaatgaaatctcatgatttctccaacccatcctataaatattcactcaggatctaaaaatcttaagtgaatgagtccaactggcaaatttaggacacctgtctaacttcctcctgacccataatggtgcaagaaaaaaaattgtcctgggaagtagttttttggcttctctgctcgaagatatgggacttggattcacaaccccaataaggaaaaaaatatctgaagaaataattctttgtttggtcaggagatatttggtgatcaaaagtcaacaaatactcgttatcatggataaccttgatagaagcatattaatatctaataagactatccttctgaaatcagcatttccttattctaggaaaataatatgactataaaataatgtaattgttattaaagaaggcttcagttattgtgattcttaaaaatatttaattaatctgctgcaaagtgaattatatgtaacattttcatcaatgccaattctaatgtagatattcttatcttgcttccaggttacaattgcttgctttctcattgtcagtaagcagtaggtattaagaacacgggttctaagtcaaactactacctcaatttgaaattcttaaattacaagtgataggattgagaggaaggttttttgtttgttttttaagtcacagtctttccatttcttcctctgtcaaatgggagatgataatattgcctacctttattagtttttcttgctgtgtagcaaattatcacaagcttatcaggttaaaacaaggaccgtttattattttatactgtctgttggtcaggaatctgggcatgagttaactgccctttgttaaaccctgtactcagggcttcacaaggctgaagttatggtctgttgagctgccgtctcatctgaggcagaaggacttcttccaaggtcactagttgttggcagagttcagtatattgaagttgtaggtcttaggtttttctagttactgttagccaggggctcttcttagcctctagaagatggccgctgttccctgccacatggccctctctacaacatgacactgtgcttcttttaggccagttatacaatctcttttcctttaaatctctttcttcagtctgttataatggagactgataaaattcaataatcataggagtgactattctaccacctttggcatataatgtaacgtaatcaagggagtgaattttccattgtattcacagattccacctatacttaagggaaaggctttaacatatattgtattaaaatattagaaatgtgtatatgtttatcttttgaattagggtaaaaaaatggaaagttatttaaagtatatgaaaatagagtaaagatattgactgaaataatagtattatagttttgtcaaaatagttctttttatatcaaatatattttattacaatttatgttatcaaatatgttttcactcctactatctcctgtcctttcttctgtaaacccattagattttaattttacttttattaatttattctgtaaaacatttttatgtgaattacatgccaatcaagcaattattatggtataaagacttcatgtgggtaaagacagtgataataactgtttatttaaaaggcaggttttatcttttcagtctactagcatcattgttggcaaaattcactggttctattttcctttataattataaagatgtttgaggaatagatatctttgttaaggatttttggtatttacttgttaatactgtaccaaatttttgataactaattagaagttttttcttttactgttcctaaattatatgtgttgtaaaagtttcttgtagtaccatagtcttatatctatgaatggaattctagaaatcgagaaatgttttaaaatgtcaaatgcacaatatacttactagagtaggaaattttaagttggtggctatttgtacagaattaatcagacattaatttagccattgagatcctctgccatttaaacatattatttgattaatttatgtactttggaaagctgttttaatctaatgtaaatcaaacaaaagttttcttcattgtcttcaaactttaatagggtgttttatgttttaggttgccaatctctttagcatttaaatatccttaagatcctttagaaattctagtgactgtgagacatatagcagtgttatgtgataaatattccaataatatagtaattaaacagggaaaaaatctttttgttttgaaatgctgggaatcatgccattgagttcatttgcatgtttgtaatatgagattttattttggtagcacttgttcttcatgatttataatgtcatgcaattaaatcttgataataaaaaatagaaaaaagtactactgtagcggtagtgctaataacttcaaaaaaagtgtattgaacttaagtactttgtattctacaatagtgctgttcatcaacatttatatatcacagtttaaattaaattagattgactctcaattacctgtttctgagcaaactggctttgacaattcactattatatcaatctgcaaagtgatgtcataatttagattagattttttaatgagaatgatgctaggaattattcttcactttgcaattctaatttccattctatactggttaatttccttactagcattggttaagttatacagaacaaaatagaagaagaagtgaatcctagtgctgatgtctatacaattttatcacaaataaattagcattttcaacatagatgagtcatttgaacacacacacacacacacacacacacacaaaacagaaaactactggttaagtagatattaaagaggatgttttaacttatacatatgatttgaaaagtggctatcataaaaatgtgctgatggagttgcccttgtatatatatattttttaaattgacacagaacacttttcgttatttgtggttcttgtcttttaaattgttatatgcttgaagaagttatcatatatattttcaaatacacttttttcttttttaaaaaagtttcaattctttttgtcatttaaccaaccaaggtaacataaattcaaaaggtagtattagaaattgttaattttatcagttaaagatgtattaactatactaattagaaatataaatgtgaatgatataacaaatatgtaagaaacacatatagaggagaatggaagattttctaatagctataaaataatactggctatgataggtacaaatgttctcaaaattctcacaaggaagatatattacatttacactacattgacagaattgagtagtgaaaccagagaccatattgcccacaaagctgaaaatatttactgtctggttctttacagaaaaagttcgttgactttttatgcaaaatgctcttatctaatcccttatccagagctattctttacaaggaataaaattgtttgaattaggtgagatggtataaatgtaaaatctgcttttctaagaaaatttcttatgacaaacattttcaacttttccagtggtaaaataaatttgagtaaagaagatttttcatttctttatattataaatttttataaagtcattaattatattttgaaatctaatgaaactcttctaaaaattttaatgcggttttgttaaatattcataataatcccatagatatttttagatggttgcccttgtaatatagtattcttttataaactaccctggtttttatataacatattgtaaacaattttagttttaatataatattaattaatgtttttaatactataagaattttttcagatcatatacttccatagtctgttactggaaatttggagttatttttgttttaaaaaagagcaaggtgatgaatatctttgtgtgcattcatcttctattttagaaaattatttcttttgcacatatgtccccaaattaaattattgggttaaagtatataaacaaatttatgattgtatattatgcactaggcattattcaaggtattgtatatgatttagtgctgttattcctaacttataaaatatttttatctaaatttttataaatgaacaaaataacttgttgaatttcatacagtaggcaattgaattgagatatgagactggtcaatttgacaccagatcccattctaccactattaactcacacttctttattttactatcattttattagtattaatattaaggctgaacatttttctatttataaaatatttactgagaagaatttataaacaaacatatttataatcttatatttatatctcaggacagcttcctgaggatattttgttttagctctagacacgcttccattttaaacctaaactggaagtgtgtaaaagttagtcatttgaaaaaaatataactatacttgatttgtttgcaattacaattaagtattacctcttggggtttgttaagaacttctacttcagaaattgtttaaaaaatgacttaatttttggcaaaggtattaaagtatgagtactatattttgggtttgatttgtgagctactgatacctttaagaattcatcaatatccataatctcagaaggcagtatatttacaataatggatcaaatgaaatattaatatataatgacttagcatagcaaatatttcagaatctctcaatagataataaaggtatatgtgacttaagattatacttctacttggactcgtgtttcatattgttatataatgttactagaatcactaaataaatattgaattaatgcagaatagaggattacagcaattctttaaatattgccttacaaatgaatattcagcacgcagtgggttctatgtgtaaatctgtaggttgaaatttagaatttttactaatgtctttatttttgtaattgctctacaagagttgcttattcaaatggcaaagtaaacacttatgtaagataatgtaaattgtggtagtttcaaaatttccatgttcttttaacttttatgtaatttgacgagaataaaaatgcttcttttattaatatatttataatactgaatcatatgtttctccttattttgtactttgatgattggataaacaaatataataatttttaattaattatgtagtaatgaatttcttcattaataagcatttattgagttattcactttgagtagtctaataaattacagtaaaaacacatataaaaatagaattaataaagtttgaatcagtcccaagaattagagctttatttaagaatcattatttgttgcttcatataggaagctcagagaattgtaaagtagaatccaaaatttatacaaaagcggactttattctgtactgaatgttgttagtaactaaaatttaggcataaaagaagttagaggtgaaggtcttaaatattctttgttttagcatatacctagatattgaataattcgtttacatattctttgcttaggttcccagttctgtactaaccgtaaggtaagaaagagtaggggataatctgtttgctaatagaagagtatatattttatttgttaagtaaataaaatggtatgttttaacatttctggacagtttttgcttttcctaaaacattttggtcctatcaaattataaatgaaaattattatttgtaattattaatttaccaacccctgtgctaatggaaaaagaaacttattg

SEQ ID NO: 2 - DNA, 8285 bp, Homo sapiens
atgcattaaaactcatagaaatgtaaaaattaaatattaaaagtctagtttgatatatgtaaattaaaatatatatgtgcatatgtataataatttcaaactattgtaaaaagatatagctaaagtagtggataataatcagatataagtcaggagagagattgatccaaggtaaacaggtcttccattcttacaaagttcggaagatatgtaaagaaaccatcgacactaaacttttttttttattatactttaagttttagggtacatgtgcacaatgtgcaggttagttacatatgtatacatgtgccatgctggtgcactgcacccactaactcgtcatctagcattaggtatacctcccattgctatccctcccccctccccccaccccacaacaggccccagagtgtgatgttccccttcctgtgtccatgtgatctcattgttcaattcccacctatgagtgagaatatgcggtgtttggttttttgttcttgcgatagtttactgagaatgatgatttccaatttcatccatatccctacaaaggacatgaactcatcattttttatggctgcatagtattccatggtgtatgtgtgccacattttcttaatccagtctatcattgttgggcatttgggttggttccaagtctttgctattgtaaatagtgccgcagtaaacatacgtgtgcacgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctcttcatgtccttcgcccactttttgatgggtttgtttgtttttttcttgtaaatttgtttgagttcattgtagattctggatattagccctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagagtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgctcgtttttctcaggtttgtcaaagatcagatagttgtacatatgtggcattatttctgagggctctgttctgttccattgatctatatctctgttttggtaccagtaccatgctgttttggttactgtatcctggtagtatagtttgaagtcaggtagtgtgatgcctccagctttgttcttttggcttaggattgacttggcgatgcgggctcttttttggttccatatgaactttaaggtagttttttccaattctgtgaagaaagtcattggtagcttgatggggatggcattgaatctatctgtaaattaccttgggcagtatggccattttcacgatattgattcttcctacccatgagcatggaatgttcttccatttgtttgtatcctcttttatttccttgagcagtggtttgtagttctccttgaagagatccgtcacatcccttgtaagttggattcctgggtattttattctctttgaagcaattgtgaatgggagttcactcatgatttggctttctgtttgtctgttgttgatgtataagaatgcttgtgatttttgtacattgattttgtatcctgaaacttcgctgaagttgcttatcagtttaaggagattttgggctgagacaatggggttttctagatatacaatcatgtcatctgcaaacggggacaatttgacttcctcttttcctaattgaataccctttatttccttctcctgtctaattgccctggccagaacttccaacactatgttgaataggagtggtgagagagggcatccctgtcttgtgccagttttcaaagggaatgcttccagtttttgcccattcagtatgatattggctgtgggtttgtcatagacagctcttattattttgagatacgtcccatcaatacctaatttattgagagtttttagcatgaagcattgttgaattttgtcaaaggcctttgctgcttctattgagatagtcatgtggtttttgtctttggttctgtttatatgctggattacatttattgatttgcgtgtattcaaccagccttgcatcccaggtatgaagcccactcgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataacgagttagggaggattccctctttttctattgattggaatagtttcagaaggaatggtaccagttcctccttgtacctctggtagaattcggctgtgaatccatctggtcctagactctttttggttggtaagctattgattattgccacaatttcagatggtgttattggtctattcagagattcaacttcttcttggtttagtcttgggagagtgtatgtatcgaggaatttatccatttcttctagattttctagtttatttgcatagaggtgtttgtagtattctctgatggtagtttgtatttctctgggatcggtggtgatatctcctttatcattttttattgcgtctatttgattcttctctctttttttctttattagtcttgctagctgtctatgaattttgttgatcctttcaaaaaaccagctcctggattcattaattttttgaaagctttttgtgtctctatttccttcagttttgctctgactttagttatttcttgccttctgctaggttttgaatgtgtttgctcttgcttttctagttcttttaattgtgatgttagggtgtcaattttggatctttcctgcttcctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaacgtatattctgttgatttggggtggagagttctgtagatgtctattaggtctgcttggtgcagagctgagttcaattcctgggtatccttgttgactttctgtctcgttgatctttctaatattgacagtggggtgttaaagtctcccattattaatgtgtgggagtctaagtctctttgtaggtcactcaggacttgctttatgaatctgcgtgctcctgtattgggtgcatatatatttaggatagttagctcttcttgttgaattgatccctttaccattatgtaatggccttctttgtctcttttgatctttgttgatttaaagtctgttttaacagagactaggattgcaacccctgtctttttttgttttccatttgcttggtagatcttccttcctccatccttttattttgagcctatgtgtgtctctgcacgtgagatgggtttcctgaatacagcacactgatgggtcttgactctttatccagtttgccagtctgtgtcttttaattggaggatttagtccatttacgtttaaagttaatattgttaggtgtgaatttgatcctgtcattatgatattagctggttattttgctggttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaacattggcccccactatcttctggcttgtagagtttctgccgagagatccgctgttagtctgatgggcttccctttgagggcaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacaccaatcagacgtggatttggtcttttcagatagtcccatatttcttggaggctttgttcgtttctttttattcttttttctctaaacttcctttctcacttcatttcattcatttcgtcttccatcactgataccctttcttccagttgttcgcatcggctcctgaggcttctgcattcttcacgtagttctcgagccttggttttcagctccatcagctcctttaagcacttctctgtattggttattctagttatacattcttctaaatttttttcagagttttcaacttctttgcctttggtttgaatgtcctcccatatctcagagtaatttgatcgtctgaagccttcttctctcagctcgtcaaagtcattctccgtccagctttgttccattgctggtgaggaactgcattcctttggaggaggagaggcgctctgctttttagagtttccagtttttctgctctgttttttccgcatctttgtggttttatctacttttggtctatgatgatggtaatgtacagatgggtttttggtgtggatgtcctttctgtttgttagttttccttctaacagacaggaccctcagctgcagctctgttggaatacctggccgtgtgaggtgtcagtctgcccctactggggggtgcctcccagttaggctgctcgggggtcaggggtcagggattcacttgaggaggcagtctgcccgttctcagatctccagctgcgtactgggagaaccactgctctcttcaaagctgtcagacagggacatttaaatctgcagaggttactgctgtctttttgtttgtctgtgccctgcccccagaggtggagcctacagagacaggcagccctccttgagctgtggtgggctccacccagttcagttggagctccctggctgctttgtttacctgaccaagccttggcaatggcgggcgcccctcccccagcctcgctgccgccttgcagtttgatctcagactgctgtgctagcaatcagtgagactccgtgggcataggaccctcccagccaggtgcggaatataatctcgtggtgtgccgttgttttagcccgtcggaaaagcgcagtattcaggtgggagtgacccgattttccaggtgccatctgtcacccctttcttcgactaggaaagggaactccctgaccccttgcgcttcccgagtgaggcaatgcctcgcccgcttcggctcgcgcatggtgcgtgcacccactgacctgcacccactgtctggcactccctagtgagatgaacctggtacctcagatggaaatgcagaaatcacccgtcttctgcctcactctcactgggagctgtagaccagagctgttcctattcggccatcttggcttctcctcccaacaagttcttttgacactaaacttttaaagtagatgtaaaaatatccattttaactattaaaataacaaagtttatcttccaaaccagtagagaaaacaaatagaacagaagtagtaatggagaaaggagaggagaggagtttattaattcaaattaaatgaaaaaaaggagaaagaaataagaaatgaaaatcaaattcaagtataatagtaaacatgataaatgcaaatggttcaaattcactaggttacacagggattatcagactggataataaatggaagttttcctttcttttttactaaaacacccctaaaacatgaagagacagtactgttgaaaatgaaaggatggaaaatgttaaacctgatatgtagcatcagtttggctctccggaatcattctagactgtcctcccttctcatccctctctcacccccaactctcacctcagctctatgccatggatggtgatttatgtatggactacataaatgagcctcttttgctgtgcagcttctgatggtctcaacctgtgggggacacaatctggagcttagagtgttggcagatagagaggtcagagcattgttctcctaagttccttcctgagagaccatagaatggcaatatgtgtgttcctctgtcaaaagccaaaactttagtaagatggccttccacagtattctgtggcctaggaagatttatgaatgcagagttctttctgctttcaaagctaagtgttttaagaaccaaaccctttgggaggaacaacaaaaattggggtgctttatgtgtggtctaagccctttgctactcatggaaaagctgggagtttggggttccttcccagtcattaggtgctgtccccaggtagggtttgtgtgtgagtgtgtcccagattttcctacccgtgttggtgtgggtatattcttattttcccagtgtgtacaagtctctcaactagtttctggttttctccaagagggattgatcaatgtgtagctgtttatttagtgcatctatggaaggagggaaaatcaagagcttcctattcttccatcttgcagatattaccactgcaaatgtccttgggacagaatggtagatataaaacaagtataagtaatttccttgcagtttttgcattttccatgtttagcattcttttcaaaggattagattgtgaattttcagtgctaaataagttatgactaacattccagctggtaatatattgatcagtagtggttgtgagaatggcaaatagataagacatagagatatgataagaaatataataaaaatgcatacctcaatggtttgtgatggtagatactggaaagaagaataatttaagatataattagactttgactataacgtattcagatatttttgaatattattaacaaacttatgatctgtaaaacattaacttctgccagtaattccagagaattatgtgcaatggttattagttgcataaagctggaggaatatttaaatgatctacttaaaattaattactctttgatcaataatcttggtcaaaaagagggcttcctatatcagtatggaaaatattatatttattcacattattttacaattatccttcctttttcattggattctcatttacttaatgaagaaaacacattaaattgttataggaactatatttcagtatctgttcctttgacagtaattgtattagagttccagacctcacacagcttaaattctcattgtacaaagtctactttcaaatgctttcaaaaagacaaaatttccctctcccccttattatttgagtgtaggatgatatattttcttggcctagatcatgatacatacttatgtctgtctttttagcaataatttttaacaaaaatttagcaaatctcattaattttgattgtaactttgaattatattgctttgatctaaaattatttatataacacataatttttcccaaaagtcttttggatcaaaaatgtcaa

SEQ ID NO: 3 - DNA, 932 bp, Homo sapiens
cactgcaaatgtccttgggacagaatggtagatataaaacaagtataagtaatttccttgcagtttttgcattttccatgtttagcattcttttcaaaggattagattgtgaattttcagtgctaaataagttatgactaacattccagctggtaatatattgatcagtagtggttgtgagaatggcaaatagataagacatagagatatgataagaaatataataaaaatgcatacctcaatggtttgtgatggtagatactggaaagaagaataatttaagatataattagactttgactataacgtattcagatatttttgaatattattaacaaacttatgatctgtaaaacattaacttctgccagtaattccagagaattatgtgcaatggttattagttgcataaagctggaggaatatttaaatgatctacttaaaattaattactctttgatcaataatcttggtcaaaaagagggcttcctatatcagtatggaaaatattatatttattcacattattttacaattatccttcctttttcattggattctcatttacttaatgaagaaaacacattaaattgttataggaactatatttcagtatctgttcctttgacagtaattgtattagagttccagacctcacacagcttaaattctcattgtacaaagtctactttcaaatgctttcaaaaagacaaaatttccctctcccccttattatttgagtgtaggatgatatattttcttggcctagatcatgatacatacttatgtctgtctttttagcaataatttttaacaaaaatttagcaaatctcattaattttgattgtaactttgaattatattgctttgatctaaaattatttatataacacataatttttcccaaaagtcttttggatcaaaaatgtcaa

SEQ ID NO: 4 - DNA, 1887 bp, Homo sapiens
taagagcctgaaaactattctaatgaggacaaagtaacagaataaacctaggcacatgcccaagggaatgaagtttaatggactgtttagaaaagcatgaggttaattaggttaagattcttagaaagtgagatttgaactaaaaaaaaaaaataataaggtgttttgctgttggaaatgagaagatcataaaattcactaagaacttatccacagtgagtatagagaagagaatgggccatcctacccattgctgaggccaaaacccatcctggctgcctctctacactcacaacccacgtctaccccatcaactagttctgctctcaatgactctatcaccgccattctggttcaaacaccatcgtcctctgtctgtttttgcagtagcttcctgccttagtcgacctactttcacccaggccctattcactctcatcacagcagccagtgtgattctgttaaaatatgcattctggtcatgtccaacctcatgttaaaaacaacagcctccaaggccctgaactatacctcgatgatcttggcttctactgcccttccccttgtttgctcactcagttgctcacacattttaatcatactggatgtgttgctgtcccatgaacacatcgggcaagcattagattctcagggcatggcgtgtgctgttcttccaacttacctactgcatggcaagatccatcaactccatccagtcattgcccagatgtcatcttctcttgaagacccaccttaacaaccatatttaaaatagtaacctcacttctgttttccttatctcccttatctgctttatttttcttcatagttcattatattctttttttgtttgtttgttttgagacaagtctcgctctgtcgcccaggctggagtgcagtggtgtgatctcggctcactgcaacctccacctcctgggttcaagcgatcctcctgcctcagcctcccaagtagctgggactacaggcttgtgataccatgcccagctaatttttgtatttttagtggagatggggttttaccatgttggccaggatggtctcgatctcttgacctcgtgatctgcccacctcggcctcccaaagtgctgggattacaggcgtgaaccactgtatgcagcccattatattctaatatactgcatcttttgcttatttgtgtgctatatcacctgtctcccgcaattagaatgttaattacatgagttcagggacttttacctgtctattatgtttataattgtctccccatctaaaatagtgtccagaacattagtaggtacacaataaatattttttggattaactacattcatttatttgtgctgggaacagcaacaaaactagtctgaagagaaggggctgaaattagacctacaaaagcctgattcagtagatttttcagttggaaaatattgagtgcttacattaagatagttatggtatgatatactgatactgaaatgaaaggtaaaaaccaaagtaaaatttaagtatagatcttaaaatgaatagccccaaaccatttcttactggaaaatttaagtctgactctattgctgctattatagcagagataagagacttacaaaatctagatgaattaacaaaagattaaaatcatttaaaatgttaggagaaaacttaataaaactcttataatgtgattgccaaaaaatgcacaaatatttccaggaagtgttaaaagttgtctattgctaattatatatttgtacttttttttacagctactcatgtgtagaacaaaaaaatagacaaaattactcaggctcaatgattcactatgtacagtttacaaattaattagcttctcttaattttttcaattaaaaaagtgttaaagcatta

SEQ ID NO: 5 - DNA, 12326 bp, Homo sapiens
ctgctacattcactatgagaaaacattcacgtctcagaaataacagtaataaggggtaagcattgccaggaggaggcagaaggcacatactggccaagtccggctctacgccctgtgtgtacagatatgtcttccaactttcgaaaagtctttgtaaaggttttcgctgatttgagctgttttcagctaagtcaccagaacatccagaatctaattttaaatgaaggttattataatgtccctcagtttcgtagcctcttattcaagagagattagaattctgtgaaggaaaagctttgttttaagttccaagggatgtaaagatttgctaggctgtctttaaatcccatttgggaactcaccatttatataaaaatggatgacatataatgtgtctttgggaacagtgaactctgaagagaaagatatggtcaaatggcccggcctcctcccacctcggaggatacactgcaccctcttcctacccctgatttggccctttcacaaatctcagctctagactgaggcagaaggacataaagatgcccatttccaaagctctccggctccccagtgcctctggttctatccatctttgtgacctgacgtctcagtggctgggtcccagatagggagctctggtctccggttcctggaggctgagcctgaatccctccacgcagaaagagagtcagggacagcaccgggggctgaatccctgccccaccttctagcagagtgacctcagtcaggtgactttactcctcaggctgtttcttttctggataacaaaaggtcattcaaccccatcttgtggattttctgtggagatttagttagataaaggactggcacacagggtgaagtgaggcagccttcccctcttccgcacagtgccacacagaacaggggtctgaggacttgccttctcccctgcatggctggtccccccctacccctgcccttccctggtgtttccaccgcaccccaccagctggaatgacatccaggattgaactcaatagccccttggcttacagggccactttctccacacctaccctggcagacttgatctcatatttgctttcagtataagatccagttgagcatccttccattaatgccccacagaacaagtctcagccttctccctggtgccggcctttccaacacctgaaggcagtgacggtgtgcttctagagtcttctcttccccacattcagcatccacagttccttccagtctgcttcacatgacaccgtctcaagcatggtgccatcctcaaaacacaccccggtttattattgctttcctgctcaagatgctctgtccagaactgatcacctctctggggtatgctgaccaccccaggggatggtctcagaaaccactttctaaattggaatatagactccatccttttcatgactcagtcaggtctcactcttaattcctaaatcccaaataattaacaaaaataccagagtcctgaggggttgctggaaaacaaaactggaaaaaaaaatccagttttcttctatcagccccattgtcccaacaaaggagggggagaggaggctacgtgcagttaccaggtgtgtcctatacaatttggtattgaaggtgattggggtgggggaaggcacgatggcatttccaaatatagaaattggttattcgtttctgctaaactgtatttagttatatctagggaaatcatttcagcctctcggagtccctttggctcacgataatgtcctcttgagtggagccatccctttttactaaatgccatatggcacattcatcaatgtgccattgatgtctttatccaagttaataaaatgattaaatgtaggcttggaatcaccactaaaattctccttgaagccaatttctacctatttatcaaattccaccactgttcatctcatgattaatctacctttaaaatactctcatgcatcactgaacgacagggatacgttctgagaagagtgtcattaagcaatttcatcattatgcgaataccacagagtgcacttacacaaacccagaaggtgcagccttctacacacccaggctctgtgctacagcccattgctcccaggctgcagacatgtgcagcacgccactgcactcaatactgtaggcaacggtaacacaacggtatttgttcactaaacatagacaaagtatggtaaaaatatgatataaaagataaaaattggctgggcgtggtggctcatgcctgtaatcccggcactttgggaggccgaggcaggcggatcacaaggtcaggagatcgagaccagcctggccagcatggtgaaaccccgtctctagtaaaaatacaaaaaaaattagctgggtgtggtggtgtgtgcctgtagtcccagctactcgggaggctgaggcaggagcatcgcgtgaacctgggagttggaggttgcagtgagtcaatatcacaccactgcactccagcctggggacagaacaagactccgtctcaaaaaaaataaataaaaaataaaagtaaaaattggtacccctatataggacacctaacaggaatgaagcttggcaggactggaagttgctctggatgagtgagtgggtggtaagtgaatatgaaggcctaggacattatactactgtagattttataagcactggacactttggccacattaaatttaccttttacaattttctttctttaataataaattaaccagctgggtgcagtggttcatgtctgtaatcccagcactttgggaggcagaggagggtagaccacttgaggtcaggagttaaaaaccagcctgatcaacatggtgaaaccccgtctctactaaaaatacaaaaattagcctggtgtggtggcatatgcctgtaatcccagctactcgggaggctgaggcaggagaattgcttgaacccaggaggcagaggttaccgtgagccgagattgtgccactgcatgcactccatcctggtcagcagaggaagactccatctcaaaataaataaataaataaaataaattaaccttagcatactgtaccttttctaactttatagacttcttaatgttttcaaactttttcactttttcatatttttgtctaacacttagattaaaacacaaacacattatacagctgtaaaaaatatttctttttatatgcgtattctataagattttgctatttaaaaatttgtttttaacttttaagacttttttattgaaaactaggacacaaatgcacacatttgctttggcctccacagggtgaggatcatcaataccactgtcttccacctgcacaccttgtcacactgggaggtcttcaggggcagtgacacacatggagctgtcatctcctgtgataacaatgccttcttctggaatagctcctgaaggacctgcctgaggctgttgtacaattaccctttttaaaaataaaaaataaaaaaaaagtaggccaggtgcagtggctcacacctgtaatcccaggactttgggaggctgaggcaagcagatcatgaggtcaggagttcgagaccagcctggccaacgtggtgaaaccccgtctctactaaaaatacaaaaattagccaggtgtggtggcgggtgcctataatcccagctacttgggaggctgaggcacaagaatcgcttgaacccagtaggtggaagttgtggtagctcagattgtgccactgcactccagcctggacgacagagcgagactcagtctcaaaaaacaacaacaacaaaaaagaagtatactctaaaataatgataaaaagcacattatgataaatgccaggcaatagaaaaatttcagctccattataatctcctgggaccaccctcctacatgtggttcatccttgaccaaagcatcattatgtggtgcctgactgtactactcaaacatattacaatgagaccatatctatttgtcttgaccacaaaaatgtcatgagaaacttactaaaatgctttgctgaaatttagatggcctctctcagtgctctcccacctaggaggctattaccccaatctgaaaataaaggaactggctttaggggttcagcagtgagaataggtgttgacaggaagaagtatccaaaggcctcccagtgggtctccggactgtgtcccttggtggcatccagggtggttgcgatcgtatggtttaaattttgtgatgatccactggagcttcaagttcagcctcaaagcattaggctctgttttctgaacatcattttatatggcaaggtcccgagattctaattttttcttgtgttaattatgtgacatggagcgtcagttaagggaaccatccaatacactttccagaaacagttctccctctcagtttcttcgtgtgcttgactggctcatggccctggggaaaccatcgctttcaatccctacctcaggtccatttcgtgatgtttatgcattcatgcgatcttagtcctcaaaggatttttttttcttctcttgggtaagatagctttagaggccttctgggataggaattataatacaactgagaacaaaggaagaaaaataaaaagtgaactactttctgttttactgaatcattcaacttgacattatctggaaatacaaaaatttgctaacacacttttcctagcctacactttgttatgctgcttgtgaaatgtatgaggtcaacacctttctacccttttttccccattgtcgcaaattctcctgctgtccagagttagtttcaaatgaccctctgctagtcttggccggcatacctaccagtggcttggagaggaattaaggaaaagcttgaaaactgaagctcatttttttgtatggtgttggctagagtttaacgtggttctccaaagccaaaaaaacattttagcagaagcggagcacacacagagataaattatttttctgtactacatttcagttggtaatttcgtacacaggattctatttctgctgctatcaagataaaatgcaaaagtggaaacattccaatgagtaagaagcaggtctgttcattcccagctcatgagaaactcaggacgcacattagtgttctgtttcccagcagcaaatagccaggacatatagcttcaatttactgggattcgaagaagtcaaatcagacctgatttcccatgaagtaaatcatagcacccagctctgtggtttgagtgacaggtacatccattattctgaaaggtcttgttactttcagcagagcttgttattcttagccctaaaaaatcatgccatgtgacagggcacctgaggctgaggaatggggcaccagcaccttccaggctttctatcttacatctgacaacttgaaacatccaggaaagaagtggaaaatccacatatcagatgtgtgctcctacccattccaaatgtctggtgtttgggaaacatttaagggatcataaattctcttttgtgtcaatgtttttggtactgtgtaattacaactatatatgtatagttatgtatatatgtatgttatactatatataaaactatatatagttacatatatgtatatatacaactatataaatatataaactataaatataaaatataaatatatatatttttatatatatatagtatattatatatatacaattttttttgagacagagtcttgccctgtttcccaggcttgagcgcaatgccgtgatctcggctcactgcaacctctgcctcccaggttcaagtgattctcttgcctcagcctcccgagtagctgggattacaggcgtccaccaccacgcccagctaattttttgtatctttagtagagatggggtttcaccatgttggccaggctggtctcaaactcctgacctcgtgatccacctgcctcggcctcccaaagtgctgggattacaggcgtaagccaccatgcccggccattacaactatattctaagattaactagcaatcataagttttttgttttcagtctagattttagaaatgcgaatgacaccaggcccaacactttgggaggccgaggcaggtggatcacgaggtcaggagttcaagaccaacctggccaagatggtgaaaccccctctctactaaaaatacaaaaaaaaaaaaattagccagacatggtggcgggcgcctgtaatctcagctattcgggaggctgatgcagagaattgcttgaacctgggaggtggaggttgcagtgagccgagattgcgccactgcactccagcctgggtaacagagcaagactccatctcaaaaaaaaaaagaaaaaaagaaacgtgagtgacaatttcaacctatttagtatccccaaaagctcaggagctgtgataaattgatacaaataaaaatgtaatacttcatctttttgcaaaatagtgcagtgggctctatgaagacatttctttttattgttgactctggaaagaaaaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 6 - DNA, 5838 bp, Homo sapiens
aaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 7 - DNA, 2877 bp, Homo sapiens
acttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 8 - DNA, 1193 bp, Homo sapiens
cagtctcagacactaatttctgttctgtctcacatctttcatatcttccctctcagtttccagccttgcctcctccacttatccgtgctggcctggtccctgccacctcctttggcactctctttgccatatagtgaatctcttattcccagcttggcattctcacccattgtcactttacctccatagcactgaccttggtagcaagtacaaattgcagtgatttcaataaccttaaggttatgataccatcagtcttgcaaatgcatggtattgttcaatgaagtctatagggagttatagaaataaagccatggataaggagaattatggtgtgctagtggaagcagtatccagttatcagtaggtgctaaagcagcattagtttttatttatatttatttagcatctttaacacccaggttaccaaaaagaacattctgtctcatgaggactttgtaaaaggagtgaaaatggatataaatgagaggggcaatgagttacttatgtattgattgaataattatttatgaatggtgactatattctgaggctgaagattactgagaggaaatgttttcatgccggctttcatggagtctatgatcagttgggagcagtatcaacaaacaataataactctttgcatccagaagcgctatcagcactggaaaaggcacgcatataatcttgttataataaaaaaatcccagagattgggcaacagattcctcagaacaggactcagagatggtgaccatgggctggagcagaagcatccatgatttattatttgtaccacactcactgaaagcctgtaagtccacatcccattaagcatgtttacttacaaatcccatccatgtgccactgcatttatatagtgtacattataaagtataactaaaatcgatattaaaggataacatttttaaaataagtaaaagcagaagttctaacatcatctgcctgagccccagtgatcacccttggcacctcctgagccgcactcctactttgataccatcagtctaatccagagtggagtcctccctgttgcttctgaagaatctggatttaataagctcatccagagatttgagataactcacaattgacaactccaagggcatcatgtgataatccagatgtttccaggatagtgggaaaaaccatttgtacaaggcatgact

SEQ ID NO: 9 - DNA, 14244 bp, Homo sapiens
gaaacttagtttagcacagttttaccctaacgtaaaaactccatggattattccggctagcccaattttctagatggtgtgtatcacttgaatattgagattctgattttttattttttgctctgtgccttaagaggcacattcttgtttccattcgagtttggggacatttacaaagtatactgtagcatacttaaattttggttataattcaaattttcattcgtatatatctttaataatgcgaaaggggggctttcattcattaaacttactgaaacaaaatccattgcatctgattcttacttagaatattaatttgaaaatctagaacctcacaattactcctttgtgaatagaagtaagaaaaaatatacgttttactatagactatatacattgctgaagttttatctgtagtaatgtgatcggcttggtaaagcatcctaaacacgttttttaaaacccagaagcaaaaatcacaaacactgctgaaatttgaaatatctaaatacctagcaatcttgagagggataaaaatggtatttcaacaacttcagtattgtaataataaaagtagattcccagagggcacgtcaatcaaagtgtaaaaatttttggaaagtaaaatgcacttttaaaaatgataagcttgcacttggcacatttttaatgatttttttaacgttatcttttgtattaaaaaggaaattcttagaatgggttgactaataccttgctcttgaggtatggacaaaccaatgatggggttttgctaatggagcctaaaatcctttttttttttaatatggaagaatatctgttcccctctcttagtgcacaaagtaacttctatatatggagttatgtattgtacatcatgaaaaaacaatgccatcaaattcaagtatcaaaataattttgctggtaaggaactgtgatgacagaccttttaaagaatttgaaattttaaaatactggtttagaggttagaaaactttaaagaattatttgtaagatatgttaataggttggtagtaggagctaaagattaagattagtctattttatttaaaattcggactaaaagtattttctagtgatttctgaaacaaaaaggttagctccactttaacttagccaattgttaagtggcatcattgtgctgagatgaaggagatggtttttttttttcatgctttttttgtcaacccacatgaaaaacaaaacaactacatcaaaaacaaagtgaactagaagtcaggagaaattctacaagatcagatcaatggttctaaaccttccctggggaactttttttctttaaagtattggcgctatttctgttggtctggacctcagcctgggttttaagagttctaaaagctccccaggaaattctaatatgtgccaaattgagaaccgctatactcgatcagtgtttcccaatgatagttaatcatcagaatcactttggggaataaatttttgttctgcccagagcaactgaatcagaatctctagggtatttttcataggctccctgggaaattcttaagaaatttggggaaaaaatggactaatctgcgggcttccaaaatactgtatctttccatataatagctattttatgctgttataaaagtttctgtgaattaagtggagaaaaatatatgaaacttggtatatggagctaggctttgtctcaaggattttattttatttattttatttttttgagacggagtctcgctctgtcgcccaggctggagtgcagtggcactgtctcagctcactgcaagctccacttcccgccttcacaccattctcctgcctcagcctcctgagtagctgggattacaggcacccgccaccacacctggctaattttttgtatttttagtagagaccacgtttcatcatgttggacaggctggtcttgaactcctgacctcaagtgatccaccagccttggcctcccaaagttttgggattacaggggtgagccactgtgcccagccaaggatattctttttataacattttcaaaaattaaggcatattgtgtatgcaggaaaaaaaatgaagcctatgatttatatttacaattgctttgattttatacaaattaaaatattactgtttatgagaatgagattctaaatgtaaatggaattcacagaatgcataatttttttctcgtttaaagaaatagagtctcgctatatgcctaggctggtcttgaactcctgggctccagccatcctcccatttcagcctcccagagtgttgggattacaggcgtgagccaccacgcctggccttgtacatgttatatagtgaacattttgcacaagattgtttgccaaatgaataatttaaaaaaaatccatttagtgtactttcctttaaatattttcacacctggagttaaaacattgtattttataagatgttattaatataaaaatacttctaattctacttgtggctatgtagaatgtagtagaggacttttgcataagcccagagcctagtttctaaaggtctttagggatttagggaaatcagagggaggtataattctggtctctcgtcgttcagttctttttcattcagttctctcaggcacgactccagccgctcagttttatatttcaactggatgttgacccaattaaaacaattcacaactcctgaagacgaaatactatgagtccctgctttggacacatctgtagtagagtaggaaaagataaatataacccaagtaattgttacagaattttctgaaatatactaatggtaaaaggttttgtagggcttgtactggggaaaaagataattttttagcatgaaccttttaagagcttgtgagtctcaaagagtctttaactgataggtgatatggataatactcccctttgggaggaggtttataatacataaacaacctccccacccttccctcgcagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagcattacaaggttcagtgaattgtctgagatctcataaatacaacctagataagaacccaggtattattattttcagtcttgcaatattattttcctacttgcaatattatcttcactcttcattaagtttgcacagcaaagtaatggaataagttctgggctttaatccttgagtagtttggaattgtaatgtgctacatttgagagagagcccttcattttgaataaaaccttggtactgatcctgatcttctaacttgggttaatgctcttccccttttcattatttttttcatttgtgaaatgaagtagttgcactagatcattttcaattttccttcccacttaaatcaattttaattaaaaaaattgcagatgccttttctcagattagagtacactttttgctccacacaatatctggtttgtaaattagtatgttccgtggagtaaataactttcctgactagccattaacttacttctgattcctgaatccactaatttaactattgttgaaattactaaaggaaatttttctttagcaaatgtaaaacctcgtatcaggtctcaggtttgatgttgtaaagcactctgactctcaggaagactctttttttcccccaacctctcataaacaaatatttcattcattataaaatttcattcattacattttcattcctcagacttaacagtgtttcgtctctgctaagtatagtgttaagcactgacaaaagaactctggacacaacatcatgaacttgctctctgggatcttataatctagttgcagaaacagattggtaaatacatagtatagcacaagtactataatggaggcctgaactgagtgctgtgggggtacacagatgaaggcttctgggagacatcatggcataactagacctggaggatgaataaaactttggccaagtaaatacagagatacacgaaaagcatggataaatggcacaagtaggttcagggatgataaaagtgttagtatgtggagagtgtacaactattttggggaatggggaaacggattaaatttggggccagaccctgaaggatgtggggatcccatcaaagtcttttaagcaggagaatgatcagatgcattttttggtatactacctgggggataggaggaaatggactacagaaggggagatcagtagaaggaagacaagttaggaagcttttcagtcattttcattaaacatgaagcttaatatgtattgttctaggatcaggaatacagcaataaagaaaaaacttggtgtaatgaaacatattttcttgggagagacagaaaataaacatgaaaaacagatgtgttcaatggtgataaagcagaaagggagatggggagtcaagtggatgtggggagggtgtttagggaagcacttatgaaagagtaacatttgagcaaagagccctgatacaagacaacaattcagacccaagacatttgaggaaagagcatccatataaagggagtgggaggtagagaaagcctggaccaggaatgagcctggtatgattgaggaaaacacaagggatttcactcttgagtgacctgggagctaatgggggattaaacagaggagggacaggatcctctatggtatatggtaagtgagtagtatggtaaatgaggtaaatgaatagtaaaaggaactgctgtggtaatttaggtaacagatgatgatggtttaggtgaaaatggttggattgtggatatggtttgattggttttagaaccaataggatttactggtggctggatgtggacaatgagagaatagaatgaaccaaagctattgtaaacgtctagaaatcagatgaggacttgaccaaaggcattggcaatgagaaagtaggcacaattcatgaggtatttcttagcattgatagagttggatataaatatctggaatttttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacactccacagtcttatcattcatagtttcttggcaaactcaccactcaaggtgtgcctcacttatttaggagatctgcctcactagggtagacattttaggtttatgactcttaagttttcacctggacagattggctaccaaaaagaacctcacaggtgggtgaccttgaattcaccaggtcatgccatcagttcagagcggccggagaactctgttctcttgtgcattgatgcccccggagttgtgaaacacagtggccctgctttagtttttttagatttagaaactgatcagtgtcagagcgatcagacacaggaatgttaattcatgttcaaaaataataaccaggctagcatttgtttagcacttgctatgtgacaggtactgttttaagtgctttacatgaattgtttaatcctcacaacaaccctgggaaataggtcctattattaggcaccctttctacagatgaggaaacagacaacagattggtaagtttcccaagatcacaaagtaagtcagtgggaactcaaagtaacctgactccagagcccactctcttatctaagcatatacattcccatcacaagagaacgccagtttattcaagtaaaataaggactagaaatttacatcaagaaatatattctttcaatgtagaatgctgaatggaaaaccaaatttcaatagttgcctactgaacaagatcatgagataacaacaagggagttgattataaatgactagaagttttaaatggcatcggcgctgataaagtgataatctcagctccatgatatacttgtcaagcagttacttacatcaatctgccttctaggatatcctttctcctggttgatgcttatatgatagtgttttgtacctttcctttttcactgcttccattgctgaccaaactactcacctccatatttctggtagatatattttttctcattgcatgttagtatcttaaatttagtcctatcttttgcttgatcctctgggcttgacttcctaatctatgttctggtttatgttttagtttgacagttgagctttctgaggacattcttattcccagtatctttttttgggtggttgggttctgggaggtggtatttgactgctgctgatgtgtaccaaccaagacagtagtcattaagtgactaacaataatgatttcagcagattattattactcttggcaaaaagcaagctttctctattataaatgattttatatttgttttgtttttctttatttgtaatttgagttctagcttaacattaatacttcagataactgttaatacactttcataaatcatacccacattcttgaatggcaaataaataaataatcaagttccgagtagtttctaaagagagtaaacattaaaagtaaacataaaactacataaaaatcaatcacagtctatttataaagttggtatgaaaacaaagatcctagatttggaacactcatgatactcaatattttacatatatcagagtttgtaatttccataacttcatttggtagttagacatatagacagagaagatattaatatattcattttatagtttaggaaacagacttggaagggcaaataacttgtctaagatgactaagcagctgagtgagaaccacagcctatctgtggcattcagtctcagccatctttcccttgcttcataaggatcgttactctggtatcagttgctggactgggattttgggcatttataaatgtttttattttggatatcactgaatcacagacaatttcatcttagttaaaaattcatctgacgtgacacttgtctaaatcttaaaatattaaattttaatgtataaggatgttaataatctttatattttaagagactatgaagtcaagtctggctaacttagatctggaagtttttagctgtggaaagcaattctattgtgtacaggtttcagcctgtgaagggaattcattgaaaatgcatagagatcagaagaactaacacctttcttgcatggatttttcttgattattggcagttaacaataaaatgttattagatcactggtgcttctgtgtggggttgagttttttatgatatctcctgttagacccataagggaggctgtgagttgttttctacatccttggactatataagatcctcttttaaaattatattttatataagcacatgaaaatggaatgaaataatgagttgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatgtgtgtgtatacaaatatgtatacacatacataatatctggagcaaaaatgattatgttgtacagaacttttggaggttttcctccttataaaattctgaagtggtagagttaacattctgcttttaatttatctccaaaaaaatgtgaagaattcccaaataagattttctcatagaagattcatggattttgagtctgagaaaaaaaaggaagaaaaaaaattcatggtataaaataactaaaaattaaatatagtctttagaaatgattttgtttagtataattaatactggtatgacaactgaatgcaattgaaattatgatataaaatttctattctgctttgtatttttcgttaaagtttttataattgtcatctgaaaaaggatttaatattcttcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctcaaattggaaaatgaatattcagatactgagtaaatttttttttttttttgagatggcatctaactctgtcacccaggctggagtgcagtggtgggatcttggctcactgtaacctctgcctcccgggttcaaattattcccctcccttagcctcctgagtagctgggactacaggcccacaacgccacgcccggctaatttttgtattttttggtagagacggggtttcaccatgttggccaggctggtctccaactcccaacctcaagggatctgctggcctcagtcttccaaagtgctggaattacaggtgtgagccactgcacctaaatgacatacttgaaaaaatattctcgggccgtgtgtggtggctcacgcctgtaatctcagcactgtggaaggttgagggtggatcacctgaggtcaggagttcaagaccagcctggctaacatggtgaaaccccatctctactaaaaatacaaaaattagctgggtgtggtggcatgcgcctgtaatcccagctacttgggaggctgaggcaggagaactgcttgaatccaggaggcggaggctgcagtgagcagagattgccccactgcactccagcctgggcgacagagcgagtctccgtctcaaaaaaaaaaaaattctcactttctgttgttgttgtttgtttaatgattaatagatgatttatttaagcaagaatacatagtcatcattgccagacttaatatgacaggttaaatgttggacccaattttccttcccagataagtttttctttcctatccatgtcagttttaaaaacataataccagaagaagaggggcccaattccacacagagctcccaagagtgagtttttaggagtgggtctgaaattaggaaagacacttgctgatcttgcataggtccagggaatcaaggcaggattttcgatgagccctcggcagttagggtaagcaggtttcagccaggctcttaatggtcaaccacttggcttgcgcccgctgggtttccaaaaatatgtcctgttcggctgggttgagggcatagtggccaggggcgaaggagtatactttgggaacgacatcttggcgacccagcgcataactcacttttttttggaaacaaggttggctctgtcttccagactggagtgcagtggcgcaatctcggcgcactgcaacctccgcctcccgagttcgggcgattgtcctgcctcagcctcccaagtagctgggactatgggcgcacaacaccacgcccagctaaattttgcatttttggtagagacggggttttgccatgttgcccaggctagtcttgagcctcctgggctcaagtgatctgcccgctttggccttccaaagtgctgggctcataggcatgacactgtgcctggacagatttttgttatactgtttagatatgatggtaactgaatgatcatgcaatctctgaccatgtgacattcagggataccaaaaatgacttgagatgggccaagggagaattggagaagcatactttggctgaatacttaggccaaagtataatttggaacatttcttttaaaaaatctactcccctatgccccccacttgcagtaccttacaattacagttaatctagtagcagatactggattgggatattaggtatttacagaccaaatgcccattgggatattactaggtaacaggcagtttcactctggttcattgtagattcatccagtaagcatttctagagaactgctatatgaaaatattgtggaaagtatcaactttttaaacttttgatgtcatggcacctagaagattattttctgatactcatattctaagggaattttgttttctgagatttgtttctgtggaatttctagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggcaagctaattcagtttgacttattcatgcaatagtctgtctctgcttatgacataaagtataatatattttaggaatagtgtggttttcttcatgatgtcaaacatacaagcttatggatatatttaaaaattcttaattttctagattaatgttcagcactacttccatcttgcattggatgggggcagataattaataattatcagatattttcttatcaaaaacaaatttgttggaaaaaaaattttttttttgagatggagtcttgttctgtcgcccaggctggaggtgcagtggcacgatctcagctcactgcaagctccacctcccgggttcacgctattgtcctgcctcagcctcccacatagctgggactacaggcgcatgccaccacgcccggctaatttttttgtatttttagtagagacagggtttcactgtgttagccaggatgctctagatctcctgacctcgtgatccgcctgccttggcctcccaaagtactgggattacaggcgtgagccaccgcccccggccgttggaaacattttgaaggaactctttgtaaataaaatacatggcatgcctttctgttttactatacagttgctgatttatcctttagttggttactttgaatcatcattaacatctgttgtcaccataatccctgtgatcactagatgtcatactccattttatgttttattgttgccttggggagactttgagagtatgagaggtgttcatgcagactgctgctgagtgttgcatagagatggaataaagtacaaataccttcaggaacagactccaaacttggtctattccagcttcctttcattttttttttttaaacctattccagataatttttcattggtattctctgaaggaaaataagagaaatttcctcttagaatcccttctccttggatttgtaacctttcccagttcatttctgtggaagtacttgtagtccagcatagtaattctattcagatatgtatagttcagttaagtcacgaagggaaaggaagctttcgttgagggctatctactaggtggtacagtgctaggtaattaactttatctcaatccttaaacaactctgcagtggtaagggtgattaattcatcccattttgtagacaaggaaactgaatgttagagggatggcataatttgttcatgttcatataggtagtactttgggaagcagaatttgaacacagatctttctggttctagagctttgtgttcttctaccttgctatgatgttaagtaattagttttaacatgccacttaagtttaaagccttaagtagtccttttaagaaatcttttgttgctggttattctcatttaacactcctattttaatttccaggttcaggtgacctcactttgccagaaccgtgggtcttcatgaaataagagatttcatttggtttttgttttggtttgcatcctctctaactttaggtagaaattgctgttagggcaatcacctacctcactatattccactctctcttctggatattggtgctcagcccttttttgaaccgcaaaccttattaataaaatagttttcattctttgagcgttcctcttctcactgcccacccccccgccaccaccaccctactgactttgatgagctgaactgaaccactcttttttttcttttttttcttttttttttttgagacagaatcccgccctgttgcccaggctggagtgcagtggcacaatatcggctcactgcaacctctacctcccagattcaagcgatttctggctaatttttgtagttttagtagagacggggtttcaccatgttggccaggctggtctcgaactcaagtgatctgcccacctcagcctcccaaagtgctagggttacaggcatgagccacccgtgccaggccctgaacactttttttttctttttctttttttttttttttttgagatggagtctcttgttcttgtcgcccaggctggagtgcagtggcgcgatcttggctcactacaagctccgcctcctggtttcatgccattctcctgcctcagcttcccaagtagctgggattacaggcgcccgcaaccacgcccagctgatttattgtattttttagtagagacggggtttcaccgtgttagccaggctggtctcgatctcctgaccttgtgatccgcctgcctcggcctcccaaagtgctgggattacaggcgtgagccaccgcgccggccctgaaccactcttcatcaacttatctgggaccctgaaatgaaatagggtgacccattttctagctttatatgattttctggcttcatatgatttaaatatttttaccgttttttgtttgttttgttttgttttgtttttgagacagggtctctgtcacccaggctgaaatacaatggcccaatgacagcttactctagcctcgacctcccaggctcaggtgattctaccaccccagcctccagagtggctggagccacagccacgcacctaacacctggttcatttttgtatttttttatagagacggggttttaccgtgttgcccaggctggtctcacactcctgggcttgaccagttcaccctccttggccttccaaagtgctgggattataggcatgaaccaccgtgcccagcttttgaaaaacctgtacaataaaaagtttggactaatgttctttgagcccttaaaaaaatgctattcaattaaaaaaaaaacaaacctatagtgtcttataactccaaatcccatactgtcacccaactggtctgccctggtgaccaccatttcctgacaaacattcaaatcactcctgaggaattgaagaaattcacatttatgacccagtgacactggccttgtctcagttcctatagtgtgtcatactctgttctgcacagaagttttgctcatcctattcctttgtttgcagaggtcccttccccatcccctatctctcaggcagactcctcatctcagtttatttacgacttcctcagggaaagccttccacacttccctgacggatgactttcccctgttgtgtgtgctcatagcaccatttacctacttcgtatacttgtgtggttattttatgtttatttgtgtgattctttgattggtgtctgtgctgtcccaagattaaaaacttcatgagagaagaaaccatgtctttttcttgtttttgtttgccattgtatccccactgagaacatggtgaataaatacgtgttaaatgaatgaatggccttttttttttttttagctggaaggacataaaattcttacatacatatagtttttaagaattatggctgcagatattttggatttcatctctggattaagtcagaatgtcagacaattgtgtacttgcacagtagtactttgttcctttacataattgttttttcttaattgaactttggtagtgtgccc

SEQ ID NO: 10 - DNA, 12613 bp, Homo sapiens
tgctgttataaaagtttctgtgaattaagtggagaaaaatatatgaaacttggtatatggagctaggctttgtctcaaggattttattttatttattttatttttttgagacggagtctcgctctgtcgcccaggctggagtgcagtggcactgtctcagctcactgcaagctccacttcccgccttcacaccattctcctgcctcagcctcctgagtagctgggattacaggcacccgccaccacacctggctaattttttgtatttttagtagagaccacgtttcatcatgttggacaggctggtcttgaactcctgacctcaagtgatccaccagccttggcctcccaaagttttgggattacaggggtgagccactgtgcccagccaaggatattctttttataacattttcaaaaattaaggcatattgtgtatgcaggaaaaaaaatgaagcctatgatttatatttacaattgctttgattttatacaaattaaaatattactgtttatgagaatgagattctaaatgtaaatggaattcacagaatgcataatttttttctcgtttaaagaaatagagtctcgctatatgcctaggctggtcttgaactcctgggctccagccatcctcccatttcagcctcccagagtgttgggattacaggcgtgagccaccacgcctggccttgtacatgttatatagtgaacattttgcacaagattgtttgccaaatgaataatttaaaaaaaatccatttagtgtactttcctttaaatattttcacacctggagttaaaacattgtattttataagatgttattaatataaaaatacttctaattctacttgtggctatgtagaatgtagtagaggacttttgcataagcccagagcctagtttctaaaggtctttagggatttagggaaatcagagggaggtataattctggtctctcgtcgttcagttctttttcattcagttctctcaggcacgactccagccgctcagttttatatttcaactggatgttgacccaattaaaacaattcacaactcctgaagacgaaatactatgagtccctgctttggacacatctgtagtagagtaggaaaagataaatataacccaagtaattgttacagaattttctgaaatatactaatggtaaaaggttttgtagggcttgtactggggaaaaagataattttttagcatgaaccttttaagagcttgtgagtctcaaagagtctttaactgataggtgatatggataatactcccctttgggaggaggtttataatacataaacaacctccccacccttccctcgcagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagcattacaaggttcagtgaattgtctgagatctcataaatacaacctagataagaacccaggtattattattttcagtcttgcaatattattttcctacttgcaatattatcttcactcttcattaagtttgcacagcaaagtaatggaataagttctgggctttaatccttgagtagtttggaattgtaatgtgctacatttgagagagagcccttcattttgaataaaaccttggtactgatcctgatcttctaacttgggttaatgctcttccccttttcattatttttttcatttgtgaaatgaagtagttgcactagatcattttcaattttccttcccacttaaatcaattttaattaaaaaaattgcagatgccttttctcagattagagtacactttttgctccacacaatatctggtttgtaaattagtatgttccgtggagtaaataactttcctgactagccattaacttacttctgattcctgaatccactaatttaactattgttgaaattactaaaggaaatttttctttagcaaatgtaaaacctcgtatcaggtctcaggtttgatgttgtaaagcactctgactctcaggaagactctttttttcccccaacctctcataaacaaatatttcattcattataaaatttcattcattacattttcattcctcagacttaacagtgtttcgtctctgctaagtatagtgttaagcactgacaaaagaactctggacacaacatcatgaacttgctctctgggatcttataatctagttgcagaaacagattggtaaatacatagtatagcacaagtactataatggaggcctgaactgagtgctgtgggggtacacagatgaaggcttctgggagacatcatggcataactagacctggaggatgaataaaactttggccaagtaaatacagagatacacgaaaagcatggataaatggcacaagtaggttcagggatgataaaagtgttagtatgtggagagtgtacaactattttggggaatggggaaacggattaaatttggggccagaccctgaaggatgtggggatcccatcaaagtcttttaagcaggagaatgatcagatgcattttttggtatactacctgggggataggaggaaatggactacagaaggggagatcagtagaaggaagacaagttaggaagcttttcagtcattttcattaaacatgaagcttaatatgtattgttctaggatcaggaatacagcaataaagaaaaaacttggtgtaatgaaacatattttcttgggagagacagaaaataaacatgaaaaacagatgtgttcaatggtgataaagcagaaagggagatggggagtcaagtggatgtggggagggtgtttagggaagcacttatgaaagagtaacatttgagcaaagagccctgatacaagacaacaattcagacccaagacatttgaggaaagagcatccatataaagggagtgggaggtagagaaagcctggaccaggaatgagcctggtatgattgaggaaaacacaagggatttcactcttgagtgacctgggagctaatgggggattaaacagaggagggacaggatcctctatggtatatggtaagtgagtagtatggtaaatgaggtaaatgaatagtaaaaggaactgctgtggtaatttaggtaacagatgatgatggtttaggtgaaaatggttggattgtggatatggtttgattggttttagaaccaataggatttactggtggctggatgtggacaatgagagaatagaatgaaccaaagctattgtaaacgtctagaaatcagatgaggacttgaccaaaggcattggcaatgagaaagtaggcacaattcatgaggtatttcttagcattgatagagttggatataaatatctggaatttttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacactccacagtcttatcattcatagtttcttggcaaactcaccactcaaggtgtgcctcacttatttaggagatctgcctcactagggtagacattttaggtttatgactcttaagttttcacctggacagattggctaccaaaaagaacctcacaggtgggtgaccttgaattcaccaggtcatgccatcagttcagagcggccggagaactctgttctcttgtgcattgatgcccccggagttgtgaaacacagtggccctgctttagtttttttagatttagaaactgatcagtgtcagagcgatcagacacaggaatgttaattcatgttcaaaaataataaccaggctagcatttgtttagcacttgctatgtgacaggtactgttttaagtgctttacatgaattgtttaatcctcacaacaaccctgggaaataggtcctattattaggcaccctttctacagatgaggaaacagacaacagattggtaagtttcccaagatcacaaagtaagtcagtgggaactcaaagtaacctgactccagagcccactctcttatctaagcatatacattcccatcacaagagaacgccagtttattcaagtaaaataaggactagaaatttacatcaagaaatatattctttcaatgtagaatgctgaatggaaaaccaaatttcaatagttgcctactgaacaagatcatgagataacaacaagggagttgattataaatgactagaagttttaaatggcatcggcgctgataaagtgataatctcagctccatgatatacttgtcaagcagttacttacatcaatctgccttctaggatatcctttctcctggttgatgcttatatgatagtgttttgtacctttcctttttcactgcttccattgctgaccaaactactcacctccatatttctggtagatatattttttctcattgcatgttagtatcttaaatttagtcctatcttttgcttgatcctctgggcttgacttcctaatctatgttctggtttatgttttagtttgacagttgagctttctgaggacattcttattcccagtatctttttttgggtggttgggttctgggaggtggtatttgactgctgctgatgtgtaccaaccaagacagtagtcattaagtgactaacaataatgatttcagcagattattattactcttggcaaaaagcaagctttctctattataaatgattttatatttgttttgtttttctttatttgtaatttgagttctagcttaacattaatacttcagataactgttaatacactttcataaatcatacccacattcttgaatggcaaataaataaataatcaagttccgagtagtttctaaagagagtaaacattaaaagtaaacataaaactacataaaaatcaatcacagtctatttataaagttggtatgaaaacaaagatcctagatttggaacactcatgatactcaatattttacatatatcagagtttgtaatttccataacttcatttggtagttagacatatagacagagaagatattaatatattcattttatagtttaggaaacagacttggaagggcaaataacttgtctaagatgactaagcagctgagtgagaaccacagcctatctgtggcattcagtctcagccatctttcccttgcttcataaggatcgttactctggtatcagttgctggactgggattttgggcatttataaatgtttttattttggatatcactgaatcacagacaatttcatcttagttaaaaattcatctgacgtgacacttgtctaaatcttaaaatattaaattttaatgtataaggatgttaataatctttatattttaagagactatgaagtcaagtctggctaacttagatctggaagtttttagctgtggaaagcaattctattgtgtacaggtttcagcctgtgaagggaattcattgaaaatgcatagagatcagaagaactaacacctttcttgcatggatttttcttgattattggcagttaacaataaaatgttattagatcactggtgcttctgtgtggggttgagttttttatgatatctcctgttagacccataagggaggctgtgagttgttttctacatccttggactatataagatcctcttttaaaattatattttatataagcacatgaaaatggaatgaaataatgagttgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatgtgtgtgtatacaaatatgtatacacatacataatatctggagcaaaaatgattatgttgtacagaacttttggaggttttcctccttataaaattctgaagtggtagagttaacattctgcttttaatttatctccaaaaaaatgtgaagaattcccaaataagattttctcatagaagattcatggattttgagtctgagaaaaaaaaggaagaaaaaaaattcatggtataaaataactaaaaattaaatatagtctttagaaatgattttgtttagtataattaatactggtatgacaactgaatgcaattgaaattatgatataaaatttctattctgctttgtatttttcgttaaagtttttataattgtcatctgaaaaaggatttaatattcttcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctcaaattggaaaatgaatattcagatactgagtaaatttttttttttttttgagatggcatctaactctgtcacccaggctggagtgcagtggtgggatcttggctcactgtaacctctgcctcccgggttcaaattattcccctcccttagcctcctgagtagctgggactacaggcccacaacgccacgcccggctaatttttgtattttttggtagagacggggtttcaccatgttggccaggctggtctccaactcccaacctcaagggatctgctggcctcagtcttccaaagtgctggaattacaggtgtgagccactgcacctaaatgacatacttgaaaaaatattctcgggccgtgtgtggtggctcacgcctgtaatctcagcactgtggaaggttgagggtggatcacctgaggtcaggagttcaagaccagcctggctaacatggtgaaaccccatctctactaaaaatacaaaaattagctgggtgtggtggcatgcgcctgtaatcccagctacttgggaggctgaggcaggagaactgcttgaatccaggaggcggaggctgcagtgagcagagattgccccactgcactccagcctgggcgacagagcgagtctccgtctcaaaaaaaaaaaaattctcactttctgttgttgttgtttgtttaatgattaatagatgatttatttaagcaagaatacatagtcatcattgccagacttaatatgacaggttaaatgttggacccaattttccttcccagataagtttttctttcctatccatgtcagttttaaaaacataataccagaagaagaggggcccaattccacacagagctcccaagagtgagtttttaggagtgggtctgaaattaggaaagacacttgctgatcttgcataggtccagggaatcaaggcaggattttcgatgagccctcggcagttagggtaagcaggtttcagccaggctcttaatggtcaaccacttggcttgcgcccgctgggtttccaaaaatatgtcctgttcggctgggttgagggcatagtggccaggggcgaaggagtatactttgggaacgacatcttggcgacccagcgcataactcacttttttttggaaacaaggttggctctgtcttccagactggagtgcagtggcgcaatctcggcgcactgcaacctccgcctcccgagttcgggcgattgtcctgcctcagcctcccaagtagctgggactatgggcgcacaacaccacgcccagctaaattttgcatttttggtagagacggggttttgccatgttgcccaggctagtcttgagcctcctgggctcaagtgatctgcccgctttggccttccaaagtgctgggctcataggcatgacactgtgcctggacagatttttgttatactgtttagatatgatggtaactgaatgatcatgcaatctctgaccatgtgacattcagggataccaaaaatgacttgagatgggccaagggagaattggagaagcatactttggctgaatacttaggccaaagtataatttggaacatttcttttaaaaaatctactcccctatgccccccacttgcagtaccttacaattacagttaatctagtagcagatactggattgggatattaggtatttacagaccaaatgcccattgggatattactaggtaacaggcagtttcactctggttcattgtagattcatccagtaagcatttctagagaactgctatatgaaaatattgtggaaagtatcaactttttaaacttttgatgtcatggcacctagaagattattttctgatactcatattctaagggaattttgttttctgagatttgtttctgtggaatttctagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggcaagctaattcagtttgacttattcatgcaatagtctgtctctgcttatgacataaagtataatatattttaggaatagtgtggttttcttcatgatgtcaaacatacaagcttatggatatatttaaaaattcttaattttctagattaatgttcagcactacttccatcttgcattggatgggggcagataattaataattatcagatattttcttatcaaaaacaaatttgttggaaaaaaaattttttttttgagatggagtcttgttctgtcgcccaggctggaggtgcagtggcacgatctcagctcactgcaagctccacctcccgggttcacgctattgtcctgcctcagcctcccacatagctgggactacaggcgcatgccaccacgcccggctaatttttttgtatttttagtagagacagggtttcactgtgttagccaggatgctctagatctcctgacctcgtgatccgcctgccttggcctcccaaagtactgggattacaggcgtgagccaccgcccccggccgttggaaacattttgaaggaactctttgtaaataaaatacatggcatgcctttctgttttactatacagttgctgatttatcctttagttggttactttgaatcatcattaacatctgttgtcaccataatccctgtgatcactagatgtcatactccattttatgttttattgttgccttggggagactttgagagtatgagaggtgttcatgcagactgctgctgagtgttgcatagagatggaataaagtacaaataccttcaggaacagactccaaacttggtctattccagcttcctttcattttttttttttaaacctattccagataatttttcattggtattctctgaaggaaaataagagaaatttcctcttagaatcccttctccttggatttgtaacctttcccagttcatttctgtggaagtacttgtagtccagcatagtaattctattcagatatgtatagttcagttaagtcacgaagggaaaggaagctttcgttgagggctatctactaggtggtacagtgctaggtaattaactttatctcaatccttaaacaactctgcagtggtaagggtgattaattcatcccattttgtagacaaggaaactgaatgttagagggatggcataatttgttcatgttcatataggtagtactttgggaagcagaatttgaacacagatctttctggttctagagctttgtgttcttctaccttgctatgatgttaagtaattagttttaacatgccacttaagtttaaagccttaagtagtccttttaagaaatcttttgttgctggttattctcatttaacactcctattttaatttccaggttcaggtgacctcactttgccagaaccgtgggtcttcatgaaataagagatttcatttggtttttgttttggtttgcatcctctctaactttaggtagaaattgctgttagggcaatcacctacctcactatattccactctctcttctggatattggtgctcagcccttttttgaaccgcaaaccttattaataaaatagttttcattctttgagcgttcctcttctcactgcccacccccccgccaccaccaccctactgactttgatgagctgaactgaaccactcttttttttcttttttttcttttttttttttgagacagaatcccgccctgttgcccaggctggagtgcagtggcacaatatcggctcactgcaacctctacctcccagattcaagcgatttctggctaatttttgtagttttagtagagacggggtttcaccatgttggccaggctggtctcgaactcaagtgatctgcccacctcagcctcccaaagtgctagggttacaggcatgagccacccgtgccaggccctgaacactttttttttctttttctttttttttttttttttgagatggagtctcttgttcttgtcgcccaggctggagtgcagtggcgcgatcttggctcactacaagctccgcctcctggtttcatgccattctcctgcctcagcttcccaagtagctgggattacaggcgcccgcaaccacgcccagctgatttattgtattttttagtagagacggggtttcaccgtgttagccaggctggtctcgatctcctgaccttgtgatccgcctgcctcggcctcccaaagtgctgggattacaggcgtgagccaccgcgccggccctgaaccactcttcatcaacttatctgggaccctgaaatgaaatagggtgacccattttctagctttatatgattttctggcttcatatgatttaaatatttttaccgttttttgtttgttttgttttgttttgtttttgagacagggtctctgtcacccaggctgaaatacaatggcccaatgacagcttactctagcctcgacctcccaggctcaggtgattctaccaccccagcctccagagtggctggagccacagccacgcacctaacacctggttcatttttgtatttttttatagagacggggttttaccgtgttgcccaggctggtctcacactcctgggcttgaccagttcaccctccttggccttccaaagtgctgggattataggcatgaaccaccgtgcccagcttttgaaaaacctgtacaataaaaagtttggactaatgttctttgagcccttaaaaaaatgctattcaattaaaaaaaaaacaaacctatagtgtcttataactccaaatcccatactgtcacccaactggtctgccctggtgaccaccatttcctgacaaacattcaaatcactcctgaggaattgaagaaattcacatttatgacccagtgacactggccttgtctcagttcctatagtgtgtcatactctgttctgcacagaagttttgctcatcctattcctttgtttgcagaggtcccttccccatcccctatctctcaggcagactcctcatctcagtttatttacgacttcctcagggaaagccttccacacttccctgacggatgactttcccctgttgtgtgtgctcatagcaccatttacctacttcgtatacttgtgtggttattttatgtttatttgtgtgattctttgattggtgtctgtgctgtcccaagattaaaaacttcatgagagaagaaaccatgtctttttcttgtttttgtttgccattgtatccccactgagaacatggtgaataaatacgtgttaaatgaatgaatggccttttttttttttttagctggaaggacataaaattcttacatacatatagtttttaagaattatggctgcagatattttggatttcatctctggattaagtcagaatgtcagacaattgtgtacttgcacagtagtactttgttcctttacataattgttttttcttaattgaactttggtagtgtgccc

SEQ ID NO: 11 - DNA, 3798 bp, Homo sapiens
agaggacttgtcaatacaacattattctgggccatctacaatgttcttaaatctgtgtttacattttgacaagagaaaaaagaagttaagcagttaatataaatgtttttaactcaaatcacatttttagattttacttatttttctatagtcttttagaaatatttctccactcacttagctgcctctttaaaagtatgtagaacataatttaacctgttcttaatagatacaatacatcactatgacttcattatagtattatgtgattttatagggataatttttgaaggcattgcatcatacagaactgtttatttttcccatcaattgaccatggactgttactattgttgagttttatctctggctataaaatatattttgtctacatcttgtgttcagctgaaacttctccctgtataaaacttcctcaaagcagttctctcttttagttttgatgttaagacataggggactaagttttgttggggttgtgtttaaagtaggagaggagattagaaaacagcacctgaatcccttattagaggaatatctaattagttttaactaatgattctgtagcatctgatattaatttggatgtcacttgtactttgtacaacgtatttttccttattaaatgagaatgtggactagatcaactctagttattagtttcaacactatataatttatttaaattatgaactgtactatacatatagtgtttggtataattaataatacaattcatgatcatgataacaataataataatgtaataataacaaatacccatgtacccactagcagttttctgatttttgtattaaccccttgccttttgtacagtttttccacatatgtatacatctttaacatgttactttacttggctgttcttaacagtaataaaataaatataatgtgtatattctctgacttgcaattttgctgaacgttaagtatctgagtttcatctatgtggattcatattgctgtatttcagtcactttctctggtgtataatacttcatgatattaattaaccatagtttatctaatctattgttgatggattttgaaattcagttttttgctattgctagtaaagttggcataaacattctggtgcatgtccaccagcacaaatttgccaccatgtttagggtgcatacctaggagtggaattgctgagtcatagaagggtatcttttcatccgggaggcaaagacatgttgcagttactgaaacccccaccaggggcagatgaaaggcctctttgcttcatgcctctgccaacacttggtattttcatatgcttaatttgcccgcatctggtaacttctcattgtgggtttaattcgcattttcctgattgcttataagtctgaacattttttccattaatttgttagctatttgtgatgtcagcaagacaattctatgattctgtttcttcaactgagcaacatttgcttttagaccttaatattattggtagttattctgtttcttctactaagcaaccctttgcttttaggcatagatgttatcagtagtctaatgttcaggaagttgtcgcctaatactttaccatgttgactctggcctaggctttatttaagcaccttcccaaaatgtacactgattttgagttggaaaagacattcttagtcactgtaacattgttgattaccctgagcaagtcctgccatgttagtatcctgccttatcctgtttattgtgtctttatagagaatcatttacagggaagcaggatgctgggatgccaggcttaatttgaggctccttatgaatcccctgaatataatggaactaaaggataacagaaacacagagtagtaatggtagacaccaaatctgagttaaaaatcttaatatgatcatttgaatttgggtatatttccaacatggtaaaatacataggcccaatatcattgttacatttatggcatatataactgtgggtttcaaacaaacgtatgtgctttgtgcaccatcccccccaatttttgtttgggtttataattttttcacctgctcccatgggacaggctaatgaagacccctgaatgaaataaagcctcagatgtacttgcagaggcctctgtagtgtgttgccttctgtgcagactcattagagatgtgagccaaggctgagacatctaagcaaaccctctgcacccagagtcctcaatccattgttcctgcatcttttttcagtctcatgggatcccagaagaatacaaattagagagaagaatctgcaaagcttttcctttcatgtttaatgtctgggcagagctgttccctgcaggacaatttctggttattttctctctctggtttgaggcatctccagggatggtttggtgactgtttcccttggggaagttttcagcagcatatcagttttactgttaaaagtttattttacaattcatctgagatagtcctgttctaaatgttctttccattacccttgtcatctggctcttgattcctgcatacccttttcagtgacactgcctcttctgggctgaaatgtgttcaataattcgagctataaatcactctcgcctccccatttggtctttacttaaccagattataaatatttaattcatttgatttttcctcataccactccagaagcttaatcatgtttagtcttcttactttaactccctctagtttgtttatatctttcttgtaatcaaggggcctaactctgatgtgctcttctaagtaagctctccagagtcatattataaaatacaaattcagcatcatctttagcttattgtacagccatagacaaacatatggtctctcaaaacttgtgttatcagttttcaggaaggactatcaatgcctaataaaatcattgagatattataaggaccaaataagaccaagtatttcattgaagatagtacaatagttactgagcctttaccaacgattacaaatagatgaataaaagatttagatgagtttctgccctgcaggggcttttcctccagtgaaggtgacaggcacacacagaggtaggtaggatacaaggtagaacaaagtactcaccgaaaagggacacaaacagttctgttcttcatgtggtttttgtcattggttctgtttatgtgatggattacatttattgatttgcgtatgttgaaccagcctttgcagggacatggatgaagttggaaaccatcattctcagcaaactaacacaggaacagaaaaccaaacaccacatgttctcactcataagtgggaggtgaacaatgagaacatatggacacaggaaggggaacatcatcatacaccggggcctactggggagttgggggctaggggagggatagcaataggagaaataagacaggctgatggatgcagcaaaccactatggcatgtgtatacctgtgtaacaaatctgcactttctgcacatgtattccagaacttaaatataatttaaaaaactcataatatattaatatttattagctaatggactgacagagccaattcattcatccttgtatccctaaattgattggaccaaaaagaggcaagggagtttaaagagttgtcaatcatgtttaaaccaaagtattggtgtggtaagaatgaggatattatggttttgcctacagatctggtggcctgttgctgtaaaaacatctccagactttcgtgaccctttcttcccatatttcttgaatgtgttccaggtattgtgttaaggtggcaatttagctta

SEQ ID NO: 12 - DNA, 2783 bp, Homo sapiens
agaacctgaaaaaaaaaaaccttaactgaagagaaggaagaataaaccacattgcctcaggtcactcaaatgttatataaaggaaacaccaagaaaaatgtttatattccttctctctacaggagcaaatataagaattttgcctagaaggtcaacttcatcctgtgcagcagtctggaaaatgtatcccagggcccttgaatacgctcagaattctatttgggaaggtttggttacagtgcagagctttccattttacatttatagagatattgtttattttcaaatgataagcagaaaattaaattgctctgactctgtaattcttaatgacttaatgatcttcatttagctaaatgttcccattgttttgtagttaaagcatgagagaaagaaaaaataagaaataaatgtggtcttataagtaactgttatatgtttactagtcttatcatttttctttaattttattgctaaatcaaattgagatacagccatcaccaatatttccccaacgcctattccatcacacagcccccacaccctcaacttaaataattgcattttaaagagtagggttttagttgcctccttcctaagtcaattaactctgcaataaaattaaaatacaaatatattcctgaaaaatatgcagagtgaaaagacatcttctacattataaaatttacaatagagaacttgacaaggctttttatagtagaaacatcaacaaaataacctaaaaaaaattttcaacctttcatttccttttctttgttatgaattctaattcatgtgacaatggaaatagctaattattcattctaaatttaatcagtatcttaagagctctgttcttttattcaactcttaagctgtctacagttcgattttgctggtactgtaatgaaaatgcaagagaaacatctaacacaactcagtaatagtaaccaaaaactcttttgaattttagaaaacctttttggaatacaaaaatttaagtttcttgaaaaacgtcaagataaaaaagattcaaatcatagtaatgtgagagaaaataatgtaatatctgttcctttacatcacaaggaaaatatattacactgttaatcttgttaatctttaacaaaacacagattaacaagaaaaaagcataacaaatttatttaaacaaagttatacacaagtaactttcagaaatgaagacccaaacccctagggaaagctttatatttttatgctaagtcttatcagagaagtggagaattgtggaaaaacatgattggacagagagcatagacaaatggaaataaactgggggaacttgagtaaggtctgattgttcaaataattgtctgcacctctgtatgatattccttcctgtattagtctgttctcacactgctataaagaactgcccaagactgggtagtttataaaggaaagaggtttaattgactcacagttctgcagggctggggaagcctcaggagacttgtaatcatggtggaaagggaagcaaacatatccttcttcacatggcagcaggaaggagaagaatgagagaagtgcagagtgaagtgggggaaagccactcatgaaaccatcagatctcatgagaactcactatcatgagaacagcattggggaacaacccccatggctcaatcacctcccacgaggtccctcccacaacacgtggggattacaatttgggttacaattcaagatgagatttgggtggggacacagaagcagaccatatcacttccccggctatggggcaggactcctgtcacatgagggtttcttttatggacagctctcacatagaaaggtgggagatagtcagagcgtgacctccaaaccaccacattttggtgtagcatgtcctgcaccccatcattaagtagaataattgtagcattacattagatagcacagttatacaattctgatgaaataatgatggataataactttatgaacctatttctggtactgatttttgtcctatttttatgtgtatggtaaaatatattatttggactcaataactgtatacaaacacatttgaattaagatattaatattagatacaaagcttttctacaaagtaaagagacatcaaaacctagagtgtgtcctggaagccaagtaaattaattagaggaaatcatggaaaatctcagtgtatggtacttcaaccatcttaaacgtctactgtcataagcagtatatatagatgaaagtaatgaatacagttagtgaacacaattacttatctccctgtaaaaagttattgttaacagtctttatatttataatctatatctgcatactctataataagcagtctaatacattggtcattgtattagtccattttcacactgctgataaagacataccagagactgggaagaaaaagaggtttattacagtctacatggctggggaggcctcacaatcatggcggaaggcaaggaggagcaagtcacatcttacatggatggtggcaggcaaagagagagcttgtgcaaggtaactcccctttttaaaaccatcacatcttgtgagagttattcactaccatgagaacagtatgggaaagacctgcctccatgattcaattacctcccacagggtccctcccacaacatatggtaattcaagattagattttggttgggacacagtcaaatcatatcagtcattatgcctatcattgctaaatttgcctattatttggtagaggtaagagaataaatcagaaaaagcca

SEQ ID NO: 13 - DNA, 4746 bp, Homo sapiens
cttttcacctaggcataacatttaaaaatatttcaaaaagattcagatggcaccatgagaaaaaataaaatttgttatccttttgtttactccattcttatgctgctatggaaaaatatccgagactgagtaatttataaaggaaaaaggtttaattgactcacaagggaggcctcaggaaacttacaattatggcagaatgggaagcaaacatgtccttcttcacatggcagcaggaaggaggctaatgagtgcccagtgaagggggaagcctgttataaagccatcagatctcatgagaacttgtgcactatcatgagaacaggatgggggaaaatgctcccatgattcagttatctccacctggtccctttcatgacatgggattatgggaactacaagatgagatttgcatagggacatagccaaaccatataattcttcccctggttcctctcaaatttcatgtcctcacaattcaaaacacaatcatgcccttccaacagtctcccaaagtcttaactcattttaacattaactcaaaagttcaagtccaaagtctcatctgaggtaaggcaagtcccttccacctctgagcttgcaaaatcaaaagcaagttggttacttcctagatacaatgtgggtacaggcattgggtaaatacacctgttccaaatgggagaaagtggccaaaacaaaggagctacagtctccatgcaagtctgaaatccaacagggcagtcattaaaccttaaggttccagaatgatctcctttgactccatgtctcacgtgcaggtcttgctgatgcaagaggtgggcttccatggccttgggcagctctactgctgtggctttgcagggcacagccccctcctggctgctttcatgggctggcattgagtgccagtggctcttccaggtgcacagtgcatgctgtcatggggtctggaggatggtggccctcttctcatggttccactaggcagtgccccactggagactctgtttgcagggttccaactccacatttcccttctatactgccctagcagaagttctccatagggctctgcctttgcaggaaacttctacctgaacatccaggtgtctccatatatcttctgaaatacaggcagagctttccaaacctcaattcttgacttctatgcacccactggctcaacaacacatggaagctgccaaggcttggggcttgcatattctgatgccatggcccaagctgtaccgtagccccttttgaccatggctggagtgtctgggaaacagggcaccaagtccctaggctgcacacagcaggaggggctctgggttgggcccttgaaaccatattttcctcctaggcctccaagcctgtgatggtaggatctgctgtgaagtctctgacatgctctggagacacttttcccattgtgttgatgattaacattcagctccttgttacttaggcaaatttccatggctggcttgaatttctccccagaaaatgggttgttaatttctgttgcattggcaggctgcaacttttccaaacttttatgctctgctgttcttgaatgctttgcagcttagaaatttcttctgccagataccctaaaatcatctctctcaagttcaaaactccacagatctctagggcagggacaaaatgccaccagtctctttgcataacgagagtgacctttactccagttcccaataagttctccatctccatctgagatcacctcagcttggacttcattggtccctatcactgtcagcattttggtcaaagccattcaacaagtctctaggaagttccaaactttcccatattttcctgtcttccgagccctccaaactgttccaatctctgcctcttacccagttctaacgttacttccacattttcagtatcattataatagctgcaccttatttatgataccaatttactgtattagtccattctcatgcttctataaagatctgcccgggactgggtaatttacaaaggaaagagatttaattgactcacagttctgcaggactggggaggctttgggaaacttacaatcatggcagaaggggaagcaaatacatccttcttcacatggtggcaggaaggaaaaaaatgaatgcccagtgaagggggaagccctttataaaaccatcagatctcatgagagctaactcactatcacgagaacagggtggggaaaccacccccatgattcaattatctccacctggctcctcacatgacacatggggattcaaactaagatttgggtgaggacgcagccaaacgatatcactctgtttattaaattgttcatctacaattttgaaggagcactctctatttgtccttatttttaaactttataaaatttttatttgaggctttagagggggtattatacttttatattatgaattttttgttctaccaagaatattttatgttgacatttttaattgaaatatatggctctattttcttgtcttagaaagtaagatatactgaacatatttgaatcacattctggtgactaacagatttttacaattgttcaggataatacttgcatgtattagtatgaaaaaattctacagttgtacacaatgtcagtgattgtactggctgtgtctttcccctagaagatgccggggtgtggtgggggaggggaagaagaaaaagaaaacttaatttttatggtaagaaatcgattattattctatcctcattttaaatcatcaagtaataataagtattaaacaataataagtatttactcaattcttactatgaaccagatatttggaacatgggaatgaagcataaatcatgttctttaaactaaaagaacttggagaaatggttgcaacagcatgtgataatgcaaattatttttggcttttatattattttataaatggccaatgagccaggacaacagtgaatttcataggagttcataaaatggaaacacgaactaaaatagtttaccaacactttgggagaaaatggaaattgagttagaatttgaagaggatcttagaagataggtgatttgggaggaagtgaaaagaagggatttaagctggttctgggaaaagaaaacagcttgagtaaagatggaaatcaatgttatttttatttagtagaagataacaaatttaccttgactgaagcagaggacatgtggagcaatcacaggaaaaaaaataactttagagtttaggccacattgtagagctgaaaggcaaaagaacttggacatttacttaaccatattacaagtcctataaaaacgttttacttagtaggagaaattatacaaatgaatcaacctattcaataatacatgaaaatgaaatgactttgtttttaattgacacagaagttttctattaaggtgatgaagtgtttgcacgtgtatgtgtgcatgttcaagtatgtttgtgtgcatgtgcgtgctggagtcatcatttatcacaataaaaggttgcagctacccacctaattaggcatgaagcaagcaaagactggataaggtgatctttgtctcactttgctcctgagacatctttgtctccagtactaatcagcagtgacgcgtcaagtcatcgtgagtgacaattacagtcctctcattacaggaaatgattgcacgactaggcagattgatgagtgtattggtgttccctaagaaactgagctcctccccaccagccctcttcttgacaacattgctgaatattattaaatacatatttaaggcaattcaggtaaagcttcttcacttggcaaaacaggttatgattgcttagaaatttattctaagagcaaaatttaacacatctccctgaattgtatcttcattctgagagtctgtgcttttctgcagtgccttttcaccttcagtttgtgcaacagtacctgtgatggtgtggattaggtgttacattttgtttagacatggaaaataaaataggtagacaaagtattttgttgaagactggttagttggaagctgagtgtcagactcatttcatttcataccttgcacttccagttgcagatacctttaaataaaacatagttcacttcttcccactacaggccaatggattggctctagcccagtggtcctcaaacttgagtgagcataggaatcacctgccctatacgcaaggtttctcgttcattagttctccagtgggccccagttacttaacatttctagaaggctcccagggggtgcagatgttgatgctgaagctgggggtctggagaccaagaaccactgaagcctgtctaaaggggtaacttcttattggtcacatttcattgcccaactgttcaattccttgatgttccccagaagctttcttgcattccaatcctatatgattttgagttctttctggacacagtctgctctgttatctgaacaaacattttatctgatgctttcctttgatttttccaatcatagtctcatggtctatcaccatgagacagggattgctttaactagagaaatgataccaatactgtttgcttagattgattttctgatttactagtattcaggcattaatatgatctggtgcctgcattctcagtaacaccaatatttgtagaaccattctaagtgtaactttgatcaaactaatcagcttggtatttttttcatggatggtccagctgtcaaaatacagatgtgttcattaa

SEQ ID NO: 14 - DNA, 17866 bp, Homo sapiens
caagtttattactgagtttattttaaaagttagtttattacttccaaagaatagaagagaaatacttttaaagtacatgtgataatatattcatataatttctaaagatcaaatcagtgtaattgggatattcatcaccttaaatatttgtctcttctttgtgctggaaacattgaaattattctcttctagctattttgaaatatataatagattattataaactataggcaccctattgagctatcaaacactaggtcttatttcttctattaaattatatatttctacccattacaaattttcctctcctccccaccccactccactgttcttcctggtctctggtaaccaccaatctactctccaccttcatagatccatttttttagctcccatatatgagtgagaatatgtgatatttgtctttctatgcttagcttatttcacttagcataatgggggcatccaattctatccatgttgttgcaaatgacaggattttactttttaatggctgaacaatattcgattgtgtatatataccacatttgctttatccattcatccattgatggagacttagcttgattccatattttggctattgcgaatagtgctgcaataaacatggaagtgcagatagctcttcagtgtactgatttgatttcttttgaatatatacctagcactgagattgctggatcatatggtagttgtagttttttagttttttgaggaaactccatatagttttccatagtgattgtactaatttacattcctacaaacatatgtatatgtttgggttccccttctctacattctcaccatcatctgatacttttttgataagcaccattttaactgggatgagatgttatctcattgtggttttgatttgcatctctgtgatgattagtgatgttgagcattttttcatgtacctgttgtccattcatatgtcttcttttgagaaatgtctattcagatcttttgtccatttttaatgagtttttttgctattgaattatttgagctccttatattctggttattaaacccttgtcagatgggtagttagcaaataatttctcccatcctgtggattgtcttttcactttgttgattgtctcctttgccgcgcagaaactttttaactcgacgtaatgccgcttttgtctatttttgctttggttgcctgtgcttttgaggtcttacacaaaaaatccttgtccagaccaatgtcctggagtgtttccccaatgttttcttctagtagtttcattgtgtcaggtcttagatttaagattttcatccatttttattttatttttgtgtatggtgagaggtagggatctagtttcattcttctacatggttgtaaactgtagtcaccctactgatctatcaaacactgggtcatacttcttctattaaactgtatgtttgtacccatcaatcaacttctctttctctcccccacccctctactcttcctgacctctagtaaccagcagtctattctctatcttcatgagatccacttttttagtttccacatgtgagtgagaacatttgatacttgttttttttcacatttgttatactcctgggctgaagtgatatataggtatgtaacactgtgcccagatggtgaataatatttttaatgtgttgttgaatttggcttgctagtattttgctgaggacttttgtatccagttttcccagcaccatttattgatgagactttcctttccccgctttgttattgatgccttcgtcaaaaataaattggctgtagccaggcacagtggctcacacctgtaattccagcacttttggaggccgaggtgggtggatcacttgagttcaggagttcgagaccagcctggtgaacatggttctactaaaaatacaaaattagccaggtatagtggcacacgcctgtagtaccagctacttgggaggctgaggcaggacaatcacttgaaaccagagggtggatattgcagtgagttgagatcgtgccactgcactccagcctgggcaacagagtgagactccatctcaaaaaataaattaataagttaaaaataaataaataaataaataaataggctataaatgcatggatttatgtctgagttctctattctgttccattggtctatgtgtctgctttttacaccagtaccatgctaatttggttactatctctttgtagtacattttaaagtcaggtagtgtgatgcctctagctttgttctttttgcttatgattgctttgggtattcagggtctttgtggttttgtataaattttagcattgttttttctgtttctatgaagaatgtcattagtattttgataagcctttctttgaatctataaattgctttgggtattactgtcgttttaacgatattcttctaatgcatgaccatggattatctttccatttttgtatgtatgtgtcctcttcaattttttttatcagtgtgttttagttttcctaatataggtctttcatttctttggtgaaattgattcctaggtattttatattttttatagctattgtaaatgggattgctttcttgatctctttttcagattgtttactgttggtgataaaatactactgatttttgtattttagttttgtatcctgcaactttactgaatttatttattagttctgacagatttttggtggggtctttaggtttttctaagtataagatcacgttgtctgtgaacaaaacaaatttgacatcttccttttcaatttggatgccctttctttctcttgcctaattcttctgtccagaattcctagtattatgttgaataaaagtgatgaaagtgtgcatccttgtcttgttctagatcttagaggaaagtcttgcaactttttttcatttagtatgatgttagctgtgagtttgtcatatatggtcttcattattttgaggtatgtttctttctttctttctttctttctttctttctttctttctttctttctttcttttctttctttctgtctctctctctgtctttcttcttcttttttttttttttaaacagggtttcacccttgttgcccagactggagtgcaatggcatggtctcggttcactaacacctccacctcccaggttcaagcagttctcctgcttcagcctcccaagtagctgggattacaggtgcctgccaccactcctggctaatttttgtatttttagtagagatggggtttcaccatgttggccaggttggtctcgaactcctgacctcaggtgatctgcccgccttggcttcccaaagtgctgggattacaggtgtgaaccactgtgcccagtgttttgaggtatgttccttctgtactcattttgttgaaggtttttatcataaagggatgctgacttttattgcatgctttttcagcatctcttgaaatgatcacatagtttttgttcttggttttgttaatgggatgtatcacatttattgatttgtgtacattgaaccatccttgcatccctgaaatgaatcccatttgatcttggggaataatttttttttttttgagacagaattttgcaatgtttcccaggttggtcttgaactcttgagctcaagtgatccccctggctcagtctcccagtagctgatactgtaggtatgtaacattgtgcccgactggtgaatgatatctttaatgtgttatggaatttggtttgctagtgttttgttgaaatttttgtgtctatgttcttcagtggtattggcctgtagttttctttttttgttctgttcttatctggttttgatattacagtaatgctgtcctcatacaatgagtttagaagtattccctcctcttcaatttttttgaagagttacagtaaaattagtattcgttctttaaatgtttggtagaattcatagtgaaaccatcaggtcctgggcttttccttgatcgtagactttttattatggcttcgattttgttattcattattggtttgttgaagttttctatttctttgttgttcaatcttggtaggttgtatagtcaaggaatttatcaattttctctaggttttccaatttgttggtgtgtaattgttcataatattctcgaatgatcctttgtatttttgtggtcttagttgttatatttccttgtatgtttctgattttatttgagtcttttctctctttttcttagtctagctaaaggtttgtctatttttgtacctttcaaaaaccaatttttcattttgtctatcttctatattttttggtctcaatttcatttatttctactctgatctttgttttggctatgaagaaatgatttttttttaaacttttaagttcaggggtacatgtgtaggtttgttacataggtaaactcatgtcatgggggtttgttggacagcttatttcatcacccaggtattaagccagtacccatgagttatttttcctgatcccttccctccttttaccctccaccatccagtaggccccactgtctgttgttcccctgtatgtgtccatgtgttctcatcatttagctcccacttatgagtgagaacatggagtatttggttttctgttcctatgtttgtttggtaaggataacggcatccagctccatgttcctgcaaaggctgcatagtattccatggtgtatatgtatcacattgtctttatccagtctaccattgatgggcatttaggttgagtttatgtctttgcttttatgaatagtgcttcagtgaatatactgtgcatgtgtctttatgatagaacaatttatattcctttggttaaatactcagtaatgagatttttgctcccatctttatttcatttcttccactaattttgtgttttgtttgctcttgcttttctagtttcttgaggtacatcgttaagttgtttatttgaagacttcctacttttctgatgtgggcttttattgctatgaactttcctgttagtactgcttttgctgtatctcatggattttggtatgttgtatttccattttcatttgtttcaagaaatttttaaatttccatctgaatttcttcattgactcattgaaaatgattgtttaatttctatgttttgtgtattttttgaggtttctctttttattgatttctagttttattccattgtggtcagaagaaatacttgatatgatttctacttttttgaatttgttgagacttcttttgtggcctaagattctggagaatctattctggagaatgtttcatgtgctgttgaaaacaatgtgtattctgcagcagctggttgaaatgttctgtaaatgtcagttaggtctgtttggtcttgtgtgtagtttaaatctgctgtgtctttgttgattttctgtctagataatctgtctactactgagagtggagtgttgaagcccttactactattacgttgcagtctatctctcccttcacatttattaatatttgctttgtatactcgaatactctagtgttgagttcatagatatttataattgttatatcctgttgatggattgactcctttatcagtatatagtgatcttctttgtcttttttagaagtctttgtagtcaatttcatctgatattaatatagctactactgctcttttttggttttcagttgcatggaatatatttttccacttccattttcagtttatgtgtgtcttaataggtgaaataggtttcttgtaggcagcatatagttgggtcttgcttctttatctattcatttgctctatgtcttttatttttactttttttttttttttttttttgagacagggtctccctctgtcacccaggctggagtgcggtggcaccatctcggctcagtgtagctcgacctttcaggctcaagcaatcctcccacctcaacctcctgagtagctgggactacaggcacatgccactgcaactggctaattttttttttatttttagtagagatggggttttgccacattgtccaggctggtcttgagctcctgaacacaagcaatttgcctgagtcagcctcccaaagtgctgggattataggtgtgagctgccgtgctcaacactctatgtcttttaattagagaattgacttcatttaaattcattgttattaatgataagtaaggattttatttttagtttttaaaatttttaaatatatttttggagacagggtcttgctctgtcactcaggctggagtgcagtggttcaatcttggcacaccacaacctctacctgccaggttcaagtgattctcgtgcctcggcctcccgagtaactggaattacaggcacatgcccctgtgcccagctaatttttgtattttagttgagatggtgtttcgccatgttggccatgctggtcttgaacttctggcctcaagtgatctgcctgcttcagccttccaaaatgctgggattataggtacaagccactgcacctagctgataagtacaggctttcaactgccattttgttgcttattttctggtggttttgtgactcctcttttcctttcttcctttcttactgttgtcctttatggctaagtggttttctctggtagcatgtttgaattcattgcttcttttttttttttaactttttaaaaatttttccgtaagttattcgggtacaggtggtatttggctacatgagtaagttctttagtggtgatttgtgagattttgttgcacccatcacccaggcagtatacattgtactctatttgtagtcttttatccctcatccccctcccagctttccccccaagtccccaaagtccattgtgtcattcttttttgttgttgttgttgttgttgttgagacagagtctcactctgtcacccaggctggagcgcagtggcacaatcttggctcactgcaacctctgcctccctggttcaagtgattctcctgcctcagcctctcccgagcagctgggactacaggggtgcaccaccacacccagctaatttttgtattttttagcagagatggggtttcaccatattggccaggctggtcttgaactgctgacctcgtgatcttcccgcctcagcctcccaaagtgctgggattataggcataagctatcatgcctggcttgtgtcattcttatgcctttgtgttctcatagcttagctcccacatatcagtgaaaacatatgatatctggtttccattcctgagttacttcacttagaataatagtctctaatctcatccaggtagctgcaaatgctgttaattcattcctctttatggctgagtagtattccatcatatatatcacagtttctttttccactcgttgattgatggcaatttgggttggttccatgattttgcaattgcgaattgtgctgctataaacatgtatgtccaagtgtcttttttgtataatgactattttcctctgggtagatccccagtagtgggattgctggatcaaatggtagttctacttttagttcttcaagaaatgtccacaccgttttccatagaggttgtactagtttacattcccaccagcagtgtagaagtgttccctgatcaccacatccacgccaacatctactgttttttttaatatatttttttattatggccattcttgcaggagtaaggtggtgttgcattgtggttttgatttgcatttccctgatcattagtgatgttgagcattttttcatgtttgttggccaattgtatatcttcttttgagaattatctattcatgtccttagctcactttttgatgggattgtttgttttttttcttactgatttgtttgagttcgttgtagattctggatattagtcctttgtcagatgtacagattgtaaagactttctccctctctgtaggttgtctgtttattctgctaaccgttccttttgccatgcaaaagctctttagtttaattaagtcccaactatttatctttgtttttattgcatttgtttttgggtttttggtgatgaaatccttgcctaagccaatgtctagaagggtttttccagtgttatcttctagaatttttatggtttcaggtcttagatttaagagttggtttttccaaggtgagagatgaggatccagtttcattctcctacatgtggccaggcaattatcccagcaccatttgttgataagggtgtcctttccccactttatgtttttgttttgtcaaagatcagttggctgtatttgggtttatttctgggttctctattctgttccattggtctatgtgccgatttttataccagtatcatgctgttttggtgactctcatgctgttttggtggtgtgatgcctccagacttgttctttttgcttagtcttgctttggctatgcgggctcttttttggttccatatgaattttagaattgtattttctaattctgtgaagaatgatggtggtattttgatggggattgcattgaatctgtagattgcttttggcagcatggtcattttcacaaatattgattctacccatccatgagcatgggatgtgtttccatttgtttgtttcatctgtgatttctttcagcagtgttttgtagtttccttgtagaggccttttgccttcttggttatgtatattcctaagttttttttttttttttttttttgcatgctattataaaaggggttgagttcttaatttgattctccacttagttgctgttggtgtataggagagctactgattttgtacattaatcttgtatccagaaggtttgctgaattcttttatcagttctaggagctttttggaagagtctttagggttttcgaggtaaacaatcatctcattggtaaacagtgacagtttgacttcctctttactgatttggatgccctttatttctttctcttgtctgattgctctggttaggacttccagtgctatgttgaagaggagtggtgagagtgggcatccttgtcttgttccaattctcagagggaatgctttcaacttttccccattcaatatcatgttggctgtgggtttgtcatagatagcttttattacattgaggtatgttccttgtatgctgattttgctgacagttttaatcataaagcgatgctggatttcttcaaatgctttttctgcatctattgagatgattgtttgatttttgtttttaattctgtttatgtggtgtatcacatttattgacttgcatatgataagccatccctgcatccctggtatgaaacccactggatcatggtggattatctttttcatatgttgttggatttagttagctagttttttgttaaggattttggcatctatgttcatcaaggatatcagtctgtagttttcttttttggttatgtcctttcctggttcatccatagaatgaattagggagggttccttctttctctatcttgtggaatagtgtcagaaagattggtaccaattcttctttgaacgtctggaagaattctgctgtgaatctgtctggtcctggacttttttttgttggtaatttttaaattaccatttcaacctcactgcttattattggtctatttagggtatctaattcttcctgatttaagctaggagggttttatctttccaggaatttatctatctcttctaggttttctagtttgtgtgtataaaggtgttcatagtagccttgaatgatcttttgtatttcattggtgtcagctgtaatatctcctgtttcatttcttaatgagattatttgaatattctctcttcttttcttggttaatcttgctaatggtctgtcaattttatttatcttttcaaagaaccatcttattgtttcatttatcttttgtattttttttgtttcaatttcatttagttctgctctgttcttggttatttcctttcttctgctgggtttgggtttggtttgttcttctttctctagttccttgagatgtgaccttagaatgtcagtttgtgctctgtcagtctttttgatgtaggtgtttaaggctatgaacttcctcttagcaccacctttgctgtatctcagaggttttgataggttgtatcattattgtctttcagttcaaagaatttttaaatttccgtcttgatttcatttttgatgcaatgctcattcaggagcagtttatttaatttccacatacttgcatggttttgaaggttccttttggaattgatttacagttttattccactgtggtctgagaggctgcttgatgtaatattaattttcttaaatttattgaagcttgttttatggcctatcatggtctatcttggagaaaggtccatgtgctattgaatagaatgtgcattctgtagttgttggatgaaatgttctgtatgtatctgttaagtccatttgttctaagatataggttaaatccattgcttctttgttgactttttgtcttgatgacctgtccagtgctgtcagtggagaactgaagtcccccactattattgtgttgctgtctatctcattgcttaggtctattagtaattagtaaatttgggacctccagtgttaagtgcatatatgtttaggattgtgatatcttcctgctggacaaggccttttaccattatataatgtccctctttgtctcttttaactgctgttgctttaaagtttgttttgtctgatataagagtagctacccctgcttgcttttggtgtccatttgcatgaaatgccttttcccacccctttactttaggtttatgtgggtccttatgtgtgagtctcctgaaggtagcaggtggttggtgagttcttatcaattctccagttctatatgttttaagcggaacatttaggccatttacatttaatgttagtgttgagatgtgaggtaccattacattcgtaatgttatttgttgtctgtgttccttgtttttgtttttgctttttaacatgtatttttgtataggtcctgtgtgatttatactttaaagaggttctgttttgatgtgtttccagtatttgttttaagatttagatctccttttagcagatcttatagtggaggcttagtagtggcgaattctctcagcattcgtttgtctgaaaaagactgtatctttccttcatatctgatgcttagtttctctggatacgaaatccttggctgataattgttttgtttgaggaggctgaagatagggccccaatcccttctagcttatagggtttctgctgagaaatctgctgttagtctgataggttttcctttataggctatctggtacttttgtctcacagctcttaagattctttccttcatcttaactctagataacctgatgacagtttgcctaggcaatgatctttttgtgttgaatttctcaggtgttctttgtgcttcttgtatttggatgtccaggtctctagcaaggctggggaagttttcctcgatttttcccccaaatatgttttccaaacttttagatttctcttcttcctcaggaatactgattattcttaggtttggtcgtttaacataatcccagacttcttggaggctttgttcatattttattattcttttttctttgtttttgttggattgggttaattcgaagatgttgtctttgaactctgaatttctttcttctgcttgttcaattatgttgctgagacttaccagagcattttgcatttctataagtgtgtccaatttttcctgaatgttttattgttttttctttatgttatctatttccttgaatatttctcccttcacttcttgtatcgttttttggatttccttgcattgggcttcgcctttctctggtgcctccctgataagcttaataactaacctcctgaaatctgtttcaggtaaatcagggatttcttcttggtttggatccattgctggtgaactagtgtgattttttggggttgttaaagagccttgttttgtcatattaccagagttggttttctggttccttcttatttgggtaggctctgtcagagggaaagtctagggctgaaggctgttgttcagattctcttgtcccacagggtgttcctttgatatagtactctcccccttttcctatggatgtggcttcctgtgagctgaactacagtgattgttctctctcttctgggtctagccacccagcaagtctacccagctctgggctggtacggggggttgtctggatagagtcctatgatgtgaaccatctgtgggtctctcagccgtggataccagtgcctgttccggtggaggtgacggttggtggtggggtcggggtgggggttgaaatggactctgtgagagtttttagctttggtggtttaatgctctatttttgtgttggttggcctcctgccaggtggtggatggggccctagaactccccaaattatatgctctttgtcttcagctaccagggtgggtagggaaggaccatcaggtagggggcatggctaggcatgtctgagctcagactgtccttgggtgggtcttgctgcagctgctgtgggagatgggggtgaggttcccaggtaagtggagttgtgtacctaggaggattatggctgcctctggtgagtcatgcaggttgtcagggaagttggggaaagctggcagtcacaggcctcacccagctcccatgcaaaccaaagggccagtctcattcccactgtgccccacccagtagtctgtttccatgtgatgggcgagctaggcttgagaacttgccccaggctgcccacctcccagctgagaaagaaaagggcttggttcttcccccttctgtggagactgcacactggattcatgccctctgcccgagttctggccaggaggcttctcaccaccagttcaaattgttacaaacttcagctgaagatttccttctccccgtggtgtttttccccactcctctggccgcccttctgatggatccctgtggtgccaggcaggaatggcctgcctgggaacccagcgagttcccagggcctttcccactgcttcctctacccctatatttcgctcagctctctaaattgactcagctccaggtaaggtcagaaatttctcccacaaacagacctccagtttctgcagtgggggtatgtatttgggagaggaggatctccctttcccactttcacagttggggcactcacagtatttgggctgtctcccgggttctgcaggaggcagtctgcttccttcagagggtctgcgggtcctttcaagattgctggtttgtttttgccattgatctggagctaaaattcacaatgcaagcctctgcacgctgctttatccatccgagttgaagctgcaatctagtcctgcctcccgtccgccatgatgatccaaactattgcttacttttctgctttttatttttagtgtatctatgataggtttttgcattatagttgccatgaggcctatgaaaaacaccttacagaaataacacattatttttaaaagatgacagcttaccttcgatcacaaaaaataaaatcaaagaaaaatctagaaaaaagctctatactttaactccattccccaagattttgacttttggttatctcaatttacatatttttatactatctatctcttaacaagttgttataactattattataattgttataactattattataatagttataactattattgtttttgacagatttttcttttggacttcatactagagttatgaatagattgcactccccaaggacagtattagaatattttgggtttgtccatgtacttaattttaccagtatgttttataccttcagatgtcttctttttgtacaaatcattggtttcattttctttcagattgaagaactccctttcacatttcttgtaagatgggtctgtttgtcgtgaattctctcaagttttgtttatttgggaaagccttttatctttccttcatatttaaaggacaagtttgctggatacagtattctccaaaggaagttttttaatttcagcaattttgaaaatgtcatctcactcccacctgccctgtatggtttctgtgaagaagtctgttgccagatgaattggagctctgtacttgcttcttttcccttgctgcttttaggatcctctctttattcttgacttttgatcagtttattatatgccttgggggagtcttatttgagtcacatctgtttgatgctctctcatcttcctgtacctggatatttatctctttctcaaattttggaaagttttttttttttttaataaactttctacccctattcttgctcaactccttgaacaccaataattcttagatttgtttttttcaggtaattttctgtatcttatagacagtctttgttggttttcattcttttctcttttttgtcctctgattatgtattttcaaatagcctgtctttgagctcactgattctttcctctgcttgatccattctgctcttgagggcctccagtgaatttttcagtttatttgctacattttcagtagcaaatgtatttgtcagttccaagatagccacttgattttttaaattgttatttcaattattttgttaaatttatctgataaatttatgaattgctcttttgtgttatcttaaagatcactgagtagccgggcgcgatggcttacacctgtaatcacaacactttgggaggccaaggcgggcagatcatgaggtcaggagtttgagaccagcctggccaacatggtgaaaccccgtctctactaaagatacaaaaaattagccgggtgtggtggtacgtgcctgtaatcccagctactcaggaggctgaggcaggagaaccacttgaacctgggaggcagaggttgcagtgagctgagatcatgccattgtacttcagcctgggtgacagggcgagactctgtctcagaaataaaaaaaaaagatcactgagtttccttaaaactgctattttgaattcttgatcatagagctcacatattgccgtcttattagggtcagtcactggctccttgctttatcaatttgagaggaccatagttccatgtttcctgatgtttcttgtggtgtgtgtttatgtcttgcattgaaggacagttcaattgaaggacagttgaagttatttgttccattctccctctggcttgttttttattgggatatttgcttatagattctgtgtaatttacctgctgactttcttttttttccccctgctaggtagctgcctcctttttggcactagatggcactttaagcccaggtttgcatcaattctagcaaacagtcagagtgccacccatcctgaatggaggaggtcccaaagggatatcccagtagtgtgggaaggctagctaggggttcatgcccaggggacctgtggaacaaatctcctacagtgtggtgctgctgaactgccatgctaatttggagtctcctttggttgagttacagagcagaatttccatggctgaggatgatagtcccacctccccactttgtttctggctgtgtttagggatatttctttcttcaagtatacctgatgccttccatgagttgaggcaggaaccgatctcctgccagggaacccaagatagtagggaagctggttgtccacctcaatatcagtttgctgtgtagaaactgtgagttgagggaaattttccatacacttgtactgggcagattgggggaaagtgtgtcatagatacagaagtctgattctcttaccatctactcagtttttacacttctctgtggctctaggaactgtctctttctcatatttgagttctgggatattgctggtaataacctgggtgctgtgtatttgtttttgtttttttgtggatggggagggggagtaaagccagcttgcttctacactgccattttggaacctgaagtttttgtgggaaggtttttaattgcagtttataatttaaattgttatatacctatttgttatatttggtagttcataatttttatatgaatatatacattttctttacattttcaaacgcattaggataaagttgaagccattttcatttttctcttattcaacttttaatgttcaaagtagtaatgttgcctttttcagttttcatgatattgagtatttgtgttcattttctcttcttaaacagtcttactggtggtttatcaattttattagtcttttcaaaaaatcaacttttggcttgtttgatccttctctataatttgttaccaagtttatttcttttctttcctttattagttccccttttgtattcctgggcttatttgatgtttttttaatatatatatattttaagtagactcttaactcattgatttttcagcttttcttccatactaatataagtatttaaactataaatatccttctattcttggtcttagctgcaacccacaagttttggtatgtaactaatgtatgtattatcaatatgtttgaaatttcattttatatattctttgacttacgagttatttaaaatattatttatttattaacatgggaatgttcttgtttttttatttttaattgtggtactctttcaacaaatttttaagtgttcaatgcaaaattgttaactataggtagatgttgtacagcagatctctagaactaacttatcttgtgtaaatgaaaggttatacctatttaatagcaactccccattttcccctcttctcaggctcctagcaactaccattctactctctgcttctattaatttcactattttagataccttataaaagtggaattgtgtattatttgttctgtgcctggcttatttcacataacatagtgtcttcaaatttcatccatattgttatatattgcagattttccttccttttaaaagctgaataataatagtctgttgtatatatatatatgccacattttctttatccatccaggatatcctcgttttttgttttgttttgttttttactaggctttagtttaattgcattgcagtcagagaacctactctgtgtgtttttaattcttccaactttgttaagcatatgttccatttttgtaaggattccttgagtccatggaaatagtgtgaatcccataatttttaggttcagtgttctgtataaatcagtcatatttgctaataatgtcatattttatccttattaatattatcacttttttgagcagttcatgagaggtgtgttaaaatctcctgctttgattatggatttattgactcctactcataggctgtctatcatttttttcattatagattttaagtctatgttatttaaggcataatttttaaattattctatcttccttgaaattttgatcagttatgaagtttccttctttagtgatgtttttgtcttgaagtctactttttctgattttaatatggccacatcagctttctttgatttttacttacatgccatatttttttcctgtccttctatttttaccctttctattttcttatattttagatgtgttgcccataaacagcattgagtttggtaggctttgtttttaatctagtgtcataattattgtcttttaattagagtatttagtccatttacatttaatgttcttatgggtttttatctaccatcttactttctacatgtcctctatattcctgtgtttcatttatggtactatttattggtgttttattctttcttactatcaccagtgatatgttaatttaattggcattttcaaaga

SEQ ID NO: 15 - DNA, 17805 bp, Homo sapiens
caagtttattactgagtttattttaaaagttagtttattacttccaaagaatagaagagaaatacttttaaagtacatgtgataatatattcatataatttctaaagatcaaatcagtgtaattgggatattcatcaccttaaatatttgtctcttctttgtgctggaaacattgaaattattctcttctagctattttgaaatatataatagattattataaactataggcaccctattgagctatcaaacactaggtcttatttcttctattaaattatatatttctacccattacaaattttcctctcctccccaccccactccactgttcttcctggtctctggtaaccaccaatctactctccaccttcatagatccatttttttagctcccatatatgagtgagaatatgtgatatttgtctttctatgcttagcttatttcacttagcataatgggggcatccaattctatccatgttgttgcaaatgacaggattttactttttaatggctgaacaatattcgattgtgtatatataccacatttgctttatccattcatccattgatggagacttagcttgattccatattttggctattgcgaatagtgctgcaataaacatggaagtgcagatagctcttcagtgtactgatttgatttcttttgaatatatacctagcactgagattgctggatcatatggtagttgtagttttttagttttttgaggaaactccatatagttttccatagtgattgtactaatttacattcctacaaacatatgtatatgtttgggttccccttctctacattctcaccatcatctgatacttttttgataagcaccattttaactgggatgagatgttatctcattgtggttttgatttgcatctctgtgatgattagtgatgttgagcattttttcatgtacctgttgtccattcatatgtcttcttttgagaaatgtctattcagatcttttgtccatttttaatgagtttttttgctattgaattatttgagctccttatattctggttattaaacccttgtcagatgggtagttagcaaataatttctcccatcctgtggattgtcttttcactttgttgattgtctcctttgccgcgcagaaactttttaactcgacgtaatgccgcttttgtctatttttgctttggttgcctgtgcttttgaggtcttacacaaaaaatccttgtccagaccaatgtcctggagtgtttccccaatgttttcttctagtagtttcattgtgtcaggtcttagatttaagattttcatccatttttattttatttttgtgtatggtgagaggtagggatctagtttcattcttctacatggttgtaaactgtagtcaccctactgatctatcaaacactgggtcatacttcttctattaaactgtatgtttgtacccatcaatcaacttctctttctctcccccacccctctactcttcctgacctctagtaaccagcagtctattctctatcttcatgagatccacttttttagtttccacatgtgagtgagaacatttgatacttgttttttttcacatttgttatactcctgggctgaagtgatatataggtatgtaacactgtgcccagatggtgaataatatttttaatgtgttgttgaatttggcttgctagtattttgctgaggacttttgtatccagttttcccagcaccatttattgatgagactttcctttccccgctttgttattgatgccttcgtcaaaaataaattggctgtagccaggcacagtggctcacacctgtaattccagcacttttggaggccgaggtgggtggatcacttgagttcaggagttcgagaccagcctggtgaacatggttctactaaaaatacaaaattagccaggtatagtggcacacgcctgtagtaccagctacttgggaggctgaggcaggacaatcacttgaaaccagagggtggatattgcagtgagttgagatcgtgccactgcactccagcctgggcaacagagtgagactccatctcaaaaaataaattaataagttaaaaataaataaataaataaataaataggctataaatgcatggatttatgtctgagttctctattctgttccattggtctatgtgtctgctttttacaccagtaccatgctaatttggttactatctctttgtagtacattttaaagtcaggtagtgtgatgcctctagctttgttctttttgcttatgattgctttgggtattcagggtctttgtggttttgtataaattttagcattgttttttctgtttctatgaagaatgtcattagtattttgataagcctttctttgaatctataaattgctttgggtattactgtcgttttaacgatattcttctaatgcatgaccatggattatctttccatttttgtatgtatgtgtcctcttcaattttttttatcagtgtgttttagttttcctaatataggtctttcatttctttggtgaaattgattcctaggtattttatattttttatagctattgtaaatgggattgctttcttgatctctttttcagattgtttactgttggtgataaaatactactgatttttgtattttagttttgtatcctgcaactttactgaatttatttattagttctgacagatttttggtggggtctttaggtttttctaagtataagatcacgttgtctgtgaacaaaacaaatttgacatcttccttttcaatttggatgccctttctttctcttgcctaattcttctgtccagaattcctagtattatgttgaataaaagtgatgaaagtgtgcatccttgtcttgttctagatcttagaggaaagtcttgcaactttttttcatttagtatgatgttagctgtgagtttgtcatatatggtcttcattattttgaggtatgtttctttctttctttctttctttctttctttctttctttctttctttctttcttttctttctttctgtctctctctctgtctttcttcttcttttttttttttttaaacagggtttcacccttgttgcccagactggagtgcaatggcatggtctcggttcactaacacctccacctcccaggttcaagcagttctcctgcttcagcctcccaagtagctgggattacaggtgcctgccaccactcctggctaatttttgtatttttagtagagatggggtttcaccatgttggccaggttggtctcgaactcctgacctcaggtgatctgcccgccttggcttcccaaagtgctgggattacaggtgtgaaccactgtgcccagtgttttgaggtatgttccttctgtactcattttgttgaaggtttttatcataaagggatgctgacttttattgcatgctttttcagcatctcttgaaatgatcacatagtttttgttcttggttttgttaatgggatgtatcacatttattgatttgtgtacattgaaccatccttgcatccctgaaatgaatcccatttgatcttggggaataatttttttttttttgagacagaattttgcaatgtttcccaggttggtcttgaactcttgagctcaagtgatccccctggctcagtctcccagtagctgatactgtaggtatgtaacattgtgcccgactggtgaatgatatctttaatgtgttatggaatttggtttgctagtgttttgttgaaatttttgtgtctatgttcttcagtggtattggcctgtagttttctttttttgttctgttcttatctggttttgatattacagtaatgctgtcctcatacaatgagtttagaagtattccctcctcttcaatttttttgaagagttacagtaaaattagtattcgttctttaaatgtttggtagaattcatagtgaaaccatcaggtcctgggcttttccttgatcgtagactttttattatggcttcgattttgttattcattattggtttgttgaagttttctatttctttgttgttcaatcttggtaggttgtatagtcaaggaatttatcaattttctctaggttttccaatttgttggtgtgtaattgttcataatattctcgaatgatcctttgtatttttgtggtcttagttgttatatttccttgtatgtttctgattttatttgagtcttttctctctttttcttagtctagctaaaggtttgtctatttttgtacctttcaaaaaccaatttttcattttgtctatcttctatattttttggtctcaatttcatttatttctactctgatctttgttttggctatgaagaaatgatttttttttaaacttttaagttcaggggtacatgtgtaggtttgttacataggtaaactcatgtcatgggggtttgttggacagcttatttcatcacccaggtattaagccagtacccatgagttatttttcctgatcccttccctccttttaccctccaccatccagtaggccccactgtctgttgttcccctgtatgtgtccatgtgttctcatcatttagctcccacttatgagtgagaacatggagtatttggttttctgttcctatgtttgtttggtaaggataacggcatccagctccatgttcctgcaaaggctgcatagtattccatggtgtatatgtatcacattgtctttatccagtctaccattgatgggcatttaggttgagtttatgtctttgcttttatgaatagtgcttcagtgaatatactgtgcatgtgtctttatgatagaacaatttatattcctttggttaaatactcagtaatgagatttttgctcccatctttatttcatttcttccactaattttgtgttttgtttgctcttgcttttctagtttcttgaggtacatcgttaagttgtttatttgaagacttcctacttttctgatgtgggcttttattgctatgaactttcctgttagtactgcttttgctgtatctcatggattttggtatgttgtatttccattttcatttgtttcaagaaatttttaaatttccatctgaatttcttcattgactcattgaaaatgattgtttaatttctatgttttgtgtattttttgaggtttctctttttattgatttctagttttattccattgtggtcagaagaaatacttgatatgatttctacttttttgaatttgttgagacttcttttgtggcctaagattctggagaatctattctggagaatgtttcatgtgctgttgaaaacaatgtgtattctgcagcagctggttgaaatgttctgtaaatgtcagttaggtctgtttggtcttgtgtgtagtttaaatctgctgtgtctttgttgattttctgtctagataatctgtctactactgagagtggagtgttgaagcccttactactattacgttgcagtctatctctcccttcacatttattaatatttgctttgtatactcgaatactctagtgttgagttcatagatatttataattgttatatcctgttgatggattgactcctttatcagtatatagtgatcttctttgtcttttttagaagtctttgtagtcaatttcatctgatattaatatagctactactgctcttttttggttttcagttgcatggaatatatttttccacttccattttcagtttatgtgtgtcttaataggtgaaataggtttcttgtaggcagcatatagttgggtcttgcttctttatctattcatttgctctatgtcttttatttttactttttttttttttttttttttgagacagggtctccctctgtcacccaggctggagtgcggtggcaccatctcggctcagtgtagctcgacctttcaggctcaagcaatcctcccacctcaacctcctgagtagctgggactacaggcacatgccactgcaactggctaattttttttttatttttagtagagatggggttttgccacattgtccaggctggtcttgagctcctgaacacaagcaatttgcctgagtcagcctcccaaagtgctgggattataggtgtgagctgccgtgctcaacactctatgtcttttaattagagaattgacttcatttaaattcattgttattaatgataagtaaggattttatttttagtttttaaaatttttaaatatatttttggagacagggtcttgctctgtcactcaggctggagtgcagtggttcaatcttggcacaccacaacctctacctgccaggttcaagtgattctcgtgcctcggcctcccgagtaactggaattacaggcacatgcccctgtgcccagctaatttttgtattttagttgagatggtgtttcgccatgttggccatgctggtcttgaacttctggcctcaagtgatctgcctgcttcagccttccaaaatgctgggattataggtacaagccactgcacctagctgataagtacaggctttcaactgccattttgttgcttattttctggtggttttgtgactcctcttttcctttcttcctttcttactgttgtcctttatggctaagtggttttctctggtagcatgtttgaattcattgcttcttttttttttttaactttttaaaaatttttccgtaagttattcgggtacaggtggtatttggctacatgagtaagttctttagtggtgatttgtgagattttgttgcacccatcacccaggcagtatacattgtactctatttgtagtcttttatccctcatccccctcccagctttccccccaagtccccaaagtccattgtgtcattcttttttgttgttgttgttgttgttgttgagacagagtctcactctgtcacccaggctggagcgcagtggcacaatcttggctcactgcaacctctgcctccctggttcaagtgattctcctgcctcagcctctcccgagcagctgggactacaggggtgcaccaccacacccagctaatttttgtattttttagcagagatggggtttcaccatattggccaggctggtcttgaactgctgacctcgtgatcttcccgcctcagcctcccaaagtgctgggattataggcataagctatcatgcctggcttgtgtcattcttatgcctttgtgttctcatagcttagctcccacatatcagtgaaaacatatgatatctggtttccattcctgagttacttcacttagaataatagtctctaatctcatccaggtagctgcaaatgctgttaattcattcctctttatggctgagtagtattccatcatatatatcacagtttctttttccactcgttgattgatggcaatttgggttggttccatgattttgcaattgcgaattgtgctgctataaacatgtatgtccaagtgtcttttttgtataatgactattttcctctgggtagatccccagtagtgggattgctggatcaaatggtagttctacttttagttcttcaagaaatgtccacaccgttttccatagaggttgtactagtttacattcccaccagcagtgtagaagtgttccctgatcaccacatccacgccaacatctactgttttttttaatatatttttttattatggccattcttgcaggagtaaggtggtgttgcattgtggttttgatttgcatttccctgatcattagtgatgttgagcattttttcatgtttgttggccaattgtatatcttcttttgagaattatctattcatgtccttagctcactttttgatgggattgtttgttttttttcttactgatttgtttgagttcgttgtagattctggatattagtcctttgtcagatgtacagattgtaaagactttctccctctctgtaggttgtctgtttattctgctaaccgttccttttgccatgcaaaagctctttagtttaattaagtcccaactatttatctttgtttttattgcatttgtttttgggtttttggtgatgaaatccttgcctaagccaatgtctagaagggtttttccagtgttatcttctagaatttttatggtttcaggtcttagatttaagagttggtttttccaaggtgagagatgaggatccagtttcattctcctacatgtggccaggcaattatcccagcaccatttgttgataagggtgtcctttccccactttatgtttttgttttgtcaaagatcagttggctgtatttgggtttatttctgggttctctattctgttccattggtctatgtgccgatttttataccagtatcatgctgttttggtgactctcatgctgttttggtggtgtgatgcctccagacttgttctttttgcttagtcttgctttggctatgcgggctcttttttggttccatatgaattttagaattgtattttctaattctgtgaagaatgatggtggtattttgatggggattgcattgaatctgtagattgcttttggcagcatggtcattttcacaaatattgattctacccatccatgagcatgggatgtgtttccatttgtttgtttcatctgtgatttctttcagcagtgttttgtagtttccttgtagaggccttttgccttcttggttatgtatattcctaagttttttttttttttttttttttgcatgctattataaaaggggttgagttcttaatttgattctccacttagttgctgttggtgtataggagagctactgattttgtacattaatcttgtatccagaaggtttgctgaattcttttatcagttctaggagctttttggaagagtctttagggttttcgaggtaaacaatcatctcattggtaaacagtgacagtttgacttcctctttactgatttggatgccctttatttctttctcttgtctgattgctctggttaggacttccagtgctatgttgaagaggagtggtgagagtgggcatccttgtcttgttccaattctcagagggaatgctttcaacttttccccattcaatatcatgttggctgtgggtttgtcatagatagcttttattacattgaggtatgttccttgtatgctgattttgctgacagttttaatcataaagcgatgctggatttcttcaaatgctttttctgcatctattgagatgattgtttgatttttgtttttaattctgtttatgtggtgtatcacatttattgacttgcatatgataagccatccctgcatccctggtatgaaacccactggatcatggtggattatctttttcatatgttgttggatttagttagctagttttttgttaaggattttggcatctatgttcatcaaggatatcagtctgtagttttcttttttggttatgtcctttcctggttcatccatagaatgaattagggagggttccttctttctctatcttgtggaatagtgtcagaaagattggtaccaattcttctttgaacgtctggaagaattctgctgtgaatctgtctggtcctggacttttttttgttggtaatttttaaattaccatttcaacctcactgcttattattggtctatttagggtatctaattcttcctgatttaagctaggagggttttatctttccaggaatttatctatctcttctaggttttctagtttgtgtgtataaaggtgttcatagtagccttgaatgatcttttgtatttcattggtgtcagctgtaatatctcctgtttcatttcttaatgagattatttgaatattctctcttcttttcttggttaatcttgctaatggtctgtcaattttatttatcttttcaaagaaccatcttattgtttcatttatcttttgtattttttttgtttcaatttcatttagttctgctctgttcttggttatttcctttcttctgctgggtttgggtttggtttgttcttctttctctagttccttgagatgtgaccttagaatgtcagtttgtgctctgtcagtctttttgatgtaggtgtttaaggctatgaacttcctcttagcaccacctttgctgtatctcagaggttttgataggttgtatcattattgtctttcagttcaaagaatttttaaatttccgtcttgatttcatttttgatgcaatgctcattcaggagcagtttatttaatttccacatacttgcatggttttgaaggttccttttggaattgatttacagttttattccactgtggtctgagaggctgcttgatgtaatattaattttcttaaatttattgaagcttgttttatggcctatcatggtctatcttggagaaaggtccatgtgctattgaatagaatgtgcattctgtagttgttggatgaaatgttctgtatgtatctgttaagtccatttgttctaagatataggttaaatccattgcttctttgttgactttttgtcttgatgacctgtccagtgctgtcagtggagaactgaagtcccccactattattgtgttgctgtctatctcattgcttaggtctattagtaattagtaaatttgggacctccagtgttaagtgcatatatgtttaggattgtgatatcttcctgctggacaaggccttttaccattatataatgtccctctttgtctcttttaactgctgttgctttaaagtttgttttgtctgatataagagtagctacccctgcttgcttttggtgtccatttgcatgaaatgccttttcccacccctttactttaggtttatgtgggtccttatgtgtgagtctcctgaaggtagcaggtggttggtgagttcttatcaattctccagttctatatgttttaagcggaacatttaggccatttacatttaatgttagtgttgagatgtgaggtaccattacattcgtaatgttatttgttgtctgtgttccttgtttttgtttttgctttttaacatgtatttttgtataggtcctgtgtgatttatactttaaagaggttctgttttgatgtgtttccagtatttgttttaagatttagatctccttttagcagatcttatagtggaggcttagtagtggcgaattctctcagcattcgtttgtctgaaaaagactgtatctttccttcatatctgatgcttagtttctctggatacgaaatccttggctgataattgttttgtttgaggaggctgaagatagggccccaatcccttctagcttatagggtttctgctgagaaatctgctgttagtctgataggttttcctttataggctatctggtacttttgtctcacagctcttaagattctttccttcatcttaactctagataacctgatgacagtttgcctaggcaatgatctttttgtgttgaatttctcaggtgttctttgtgcttcttgtatttggatgtccaggtctctagcaaggctggggaagttttcctcgatttttcccccaaatatgttttccaaacttttagatttctcttcttcctcaggaatactgattattcttaggtttggtcgtttaacataatcccagacttcttggaggctttgttcatattttattattcttttttctttgtttttgttggattgggttaattcgaagatgttgtctttgaactctgaatttctttcttctgcttgttcaattatgttgctgagacttaccagagcattttgcatttctataagtgtgtccaatttttcctgaatgttttattgttttttctttatgttatctatttccttgaatatttctcccttcacttcttgtatcgttttttggatttccttgcattgggcttcgcctttctctggtgcctccctgataagcttaataactaacctcctgaaatctgtttcaggtaaatcagggatttcttcttggtttggatccattgctggtgaactagtgtgattttttggggttgttaaagagccttgttttgtcatattaccagagttggttttctggttccttcttatttgggtaggctctgtcagagggaaagtctagggctgaaggctgttgttcagattctcttgtcccacagggtgttcctttgatatagtactctcccccttttcctatggatgtggcttcctgtgagctgaactacagtgattgttctctctcttctgggtctagccacccagcaagtctacccagctctgggctggtacggggggttgtctggatagagtcctatgatgtgaaccatctgtgggtctctcagccgtggataccagtgcctgttccggtggaggtgacggttggtggtggggtcggggtgggggttgaaatggactctgtgagagtttttagctttggtggtttaatgctctatttttgtgttggttggcctcctgccaggtggtggatggggccctagaactccccaaattatatgctctttgtcttcagctaccagggtgggtagggaaggaccatcaggtagggggcatggctaggcatgtctgagctcagactgtccttgggtgggtcttgctgcagctgctgtgggagatgggggtgaggttcccaggtaagtggagttgtgtacctaggaggattatggctgcctctggtgagtcatgcaggttgtcagggaagttggggaaagctggcagtcacaggcctcacccagctcccatgcaaaccaaagggccagtctcattcccactgtgccccacccagtagtctgtttccatgtgatgggcgagctaggcttgagaacttgccccaggctgcccacctcccagctgagaaagaaaagggcttggttcttcccccttctgtggagactgcacactggattcatgccctctgcccgagttctggccaggaggcttctcaccaccagttcaaattgttacaaacttcagctgaagatttccttctccccgtggtgtttttccccactcctctggccgcccttctgatggatccctgtggtgccaggcaggaatggcctgcctgggaacccagcgagttcccagggcctttcccactgcttcctctacccctatatttcgctcagctctctaaattgactcagctccaggtaaggtcagaaatttctcccacaaacagacctccagtttctgcagtgggggtatgtatttgggagaggaggatctccctttcccactttcacagttggggcactcacagtatttgggctgtctcccgggttctgcaggaggcagtctgcttccttcagagggtctgcgggtcctttcaagattgctggtttgtttttgccattgatctggagctaaaattcacaatgcaagcctctgcacgctgctttatccatccgagttgaagctgcaatctagtcctgcctcccgtccgccatgatgatccaaactattgcttacttttctgctttttatttttagtgtatctatgataggtttttgcattatagttgccatgaggcctatgaaaaacaccttacagaaataacacattatttttaaaagatgacagcttaccttcgatcacaaaaaataaaatcaaagaaaaatctagaaaaaagctctatactttaactccattccccaagattttgacttttggttatctcaatttacatatttttatactatctatctcttaacaagttgttataactattattataattgttataactattattataatagttataactattattgtttttgacagatttttcttttggacttcatactagagttatgaatagattgcactccccaaggacagtattagaatattttgggtttgtccatgtacttaattttaccagtatgttttataccttcagatgtcttctttttgtacaaatcattggtttcattttctttcagattgaagaactccctttcacatttcttgtaagatgggtctgtttgtcgtgaattctctcaagttttgtttatttgggaaagccttttatctttccttcatatttaaaggacaagtttgctggatacagtattctccaaaggaagttttttaatttcagcaattttgaaaatgtcatctcactcccacctgccctgtatggtttctgtgaagaagtctgttgccagatgaattggagctctgtacttgcttcttttcccttgctgcttttaggatcctctctttattcttgacttttgatcagtttattatatgccttgggggagtcttatttgagtcacatctgtttgatgctctctcatcttcctgtacctggatatttatctctttctcaaattttggaaagttttttttttttttaataaactttctacccctattcttgctcaactccttgaacaccaataattcttagatttgtttttttcaggtaattttctgtatcttatagacagtctttgttggttttcattcttttctcttttttgtcctctgattatgtattttcaaatagcctgtctttgagctcactgattctttcctctgcttgatccattctgctcttgagggcctccagtgaatttttcagtttatttgctacattttcagtagcaaatgtatttgtcagttccaagatagccacttgattttttaaattgttatttcaattattttgttaaatttatctgataaatttatgaattgctcttttgtgttatcttaaagatcactgagtagccgggcgcgatggcttacacctgtaatcacaacactttgggaggccaaggcgggcagatcatgaggtcaggagtttgagaccagcctggccaacatggtgaaaccccgtctctactaaagatacaaaaaattagccgggtgtggtggtacgtgcctgtaatcccagctactcaggaggctgaggcaggagaaccacttgaacctgggaggcagaggttgcagtgagctgagatcatgccattgtacttcagcctgggtgacagggcgagactctgtctcagaaataaaaaaaaaagatcactgagtttccttaaaactgctattttgaattcttgatcatagagctcacatattgccgtcttattagggtcagtcactggctccttgctttatcaatttgagaggaccatagttccatgtttcctgatgtttcttgtggtgtgtgtttatgtcttgcattgaaggacagttcaattgaaggacagttgaagttatttgttccattctccctctggcttgttttttattgggatatttgcttatagattctgtgtaatttacctgctgactttcttttttttccccctgctaggtagctgcctcctttttggcactagatggcactttaagcccaggtttgcatcaattctagcaaacagtcagagtgccacccatcctgaatggaggaggtcccaaagggatatcccagtagtgtgggaaggctagctaggggttcatgcccaggggacctgtggaacaaatctcctacagtgtggtgctgctgaactgccatgctaatttggagtctcctttggttgagttacagagcagaatttccatggctgaggatgatagtcccacctccccactttgtttctggctgtgtttagggatatttctttcttcaagtatacctgatgccttccatgagttgaggcaggaaccgatctcctgccagggaacccaagatagtagggaagctggttgtccacctcaatatcagtttgctgtgtagaaactgtgagttgagggaaattttccatacacttgtactgggcagattgggggaaagtgtgtcatagatacagaagtctgattctcttaccatctactcagtttttacacttctctgtggctctaggaactgtctctttctcatatttgagttctgggatattgctggtaataacctgggtgctgtgtatttgtttttgtttttttgtggatggggagggggagtaaagccagcttgcttctacactgccattttggaacctgaagtttttgtgggaaggtttttaattgcagtttataatttaaattgttatatacctatttgttatatttggtagttcataatttttatatgaatatatacattttctttacattttcaaacgcattaggataaagttgaagccattttcatttttctcttattcaacttttaatgttcaaagtagtaatgttgcctttttcagttttcatgatattgagtatttgtgttcattttctcttcttaaacagtcttactggtggtttatcaattttattagtcttttcaaaaaatcaacttttggcttgtttgatccttctctataatttgttaccaagtttatttcttttctttcctttattagttccccttttgtattcctgggcttatttgatgtttttttaatatatatatattttaagtagactcttaactcattgatttttcagcttttcttccatactaatataagtatttaaactataaatatccttctattcttggtcttagctgcaacccacaagttttggtatgtaactaatgtatgtattatcaatatgtttgaaatttcattttatatattctttgacttacgagttatttaaaatattatttatttattaacatgggaatgttcttgtttttttatttttaattgtggtactctttcaacaaatttttaagtgttcaatgcaaaattgttaactataggtagatgttgtacagcagatctctagaactaacttatcttgtgtaaatgaaaggttatacctatttaatagcaactccccattttcccctcttctcaggctcctagcaactaccattctactctctgcttctattaatttcactattttagataccttataaaagtggaattgtgtattatttgttctgtgcctggcttatttcacataacatagtgtcttcaaatttcatccatattgttatatattgcagattttccttccttttaaaagctgaataataatagtctgttgtatatatatatatgccacattttctttatccatccaggatatcctcgttttttgttttgttttgttttttactaggctttagtttaattgcattgcagtcagagaacctactctgtgtgtttttaattcttccaactttgttaagcatatgttccatttttgtaaggattccttgagtccatggaaatagtgtgaatcccataatttttaggttcagtgttctgtataaatcagtcatatttgctaataatgtcatattttatccttattaatattatcacttttttgagcagttcatgagaggtgtgttaaaatctcctgctttgattatggatttattgactcctactcataggctgtctatcatttttttcattatagattttaagtctatgttatttaaggcataatttttaaattattctatcttccttgaaattttgatcagttatgaagtttccttctttagtgatgtttttgtcttgaagtctactttttctgattttaatatggccacatcagctttctttgatttttacttacatgccatatttttttcctgtccttctatttttaccctttctattttcttatattttagatgtgttgcccataaacagcattgagtttggtaggctttgtttttaatctagtgtcataattattgtcttttaattagagtatttagtccatttacatttaatgttcttatgggtttttatctaccatcttactttctacatgtcctctatattcctgtgtttcatttatggtactatttatt

SEQ ID NO: 16 - DNA, 11241 bp, Homo sapiens
caacagaatcgtatcatgctcacaattgttaaacttgcctttccaattaatagcaattcatctttaacatatcttgctaacctaccaccacatttaataacagacttagtcctttgcttggaggtatcttaattaacttgactaaggaagagtatttttaaatacacaacagaatactgaaggaaaatgacactctctttgaattgaaatcaaaatagtacattacagaaaaagagatgccgatggaaccctgtctagcatacatcttttgttcaggcagttaagctcaaaggtgatgtgcaaaacaggtttttggaccaatctctgactcttccaccttcttccaacaatgagctcgaatggattccacatttcttttgctccagttctacatacagtcaacaatcaacaaaacgacttacaacatgtaagtggcagagcaaatccaagtgttgtttgcttgccttttctatcagccttgtttattcctacttgtctgaaatagctgccaattggatcacgggcacatcatcacgagagtaatcactagtagtgctacttgctattattcattttagtgttgctagtattgatgagcacatcttgggttatctgcagagttgaccatccacaccagtgctcaccttcacttcttcttcgtactggaatctccgtttgctcacaatgatatcttcaataccccgcctatcaccaaacttcttctcaaagatggtataatttttaaagagttcttgggcatcttgttttgaaattctgtccagggcatacttgtaaatcactcgtaccctttcaaactaaatgcagacaggatgattaccttctataacacaatattctcatgccagtcacaactaggagagtaaatataacaaaatattacttataagttagattttgaggcctcataatatccagagtaagatgcttttctccctcttgttgaaggttatctctgtcaggatggaccggtactctgctttgagctccatatttaatactgtctacctaacactgccaactggatgtctactgcacatctcaaacaggtccaaaactgagcttctgtttcctccccactcaaactgggactctccccatcttcccaattttagtaggcaaggcctaacctacagtcacttgctcaagccaaaaccttcaggtgatcctcaattcctcttttttcctcatactccatattcactcttgcaacatgccctaccatttcaatctcttccacacagccatttgcttctccccagcccccagccatcaaactccactgttcacctggcccacttcaaaagtctccccactggtctcccctggttccacttttgccatctaccctcatacattctccatgaattagccagaggctctccttaaaatataaatcatatccaatcactgtcccgcttaaaacctttcaatgcttcccactggcccgaacagaatctgaactccctagcatggtccgtgcaagaccttatataggttgagtatctcttgtctgaagcatttggtatcagaagtgttttggatttgggatgtttccccagtttgggaatatttgcattatacttactggttcagcatccctaatccaaaaacccgaagtctgaaatgttccaatgaacatttccttcgagtgtcatgtcagcactcaacaagtttcacattttgagttttggattttcagactgggaatgctcaaacctgtatttggatggatctcaattctgtattatttgaactccctttttttttaagaaatggggtcctgctctgtcacccaggctagagtgcaatggcacgaacatagctcattgtagtctcaaactcctaggctcaagtgatactcctgcctcagcttcccaagtagctgggactgtaggtgtgcaccactatgcccactcaatttttttttttagagacagggtctcactatgttgcccaggctggtctcaaactcctggcctcaagtgatccttctgcctcatcttctcaatatttgagctattttcataggtacaagggaaaaaaagaactctcttatttgtagggcaatctctgtttccattctaaatgttttctgttctagggctttaagctttttgtttcccatatttattatcggttaagtcctttacttaggatgccaaaagactagttctcagtttacgggcattcagactaaaaggcttaattttcaaacaaagcacaataaaattaagacagttataatacaatctataatcagctcccatctgtagcttagtcacatatatatgctgttctctgtgagaagctgtgtttttgtattttgaaaacatctttccagggatatgtcagtaagaaaaaatggaaatgaactcaccatgcacaaaatgtaatctttgctaagctgttttacagtataatgaagttaggtatacttacctctttctgattttcttcaaacttggcaaaggcaacataaaggtgctcatccatatgttcatctccaaagaattccacagctctctcatacactttccgtgcatgggcaaaataagcatgtttttcttcaaagcgggcatacttgatccagttcttaacatcagggtgcacgaggacaagtgcaagggaattaaggaaatcccaggcaaaacagcatggcttaaaaaaatagtaagtaagtaaacaccaaaaccataccaaagcctggaaactccaaaaattcaaactacaactctaggggaacaaaacacatacaaaagtgtagaattaaacagtggcttctgtgagagcagggccacgcctgttcatctctattttcctccagtgcttagttaagattttagtggtgggtataaactcgagttggaagcaaagaaaaatctcaacccaggttaccaaccatgtgatcttggataagtcactgaacttagacgtctaagtctcagctgtttcatttgtaaacagggaaaaataatgccagcctcactggattactgccagctttaaatgagaaaatgtatgtaaagcccttagcacagtttctagccaaaagaacatggcaccgtaagcggtcaataatggtctggtcattaaatagcaccaattatattaaaatatgaatacttgaactaataattaagaaaaaaacatgctataaaaagaaaactgttaactagagtcaaagcagaaagttttgaattgtcattttaatctatcttccttgaataaatcattaatttccaaagtagtaatatattccaatatggcaaagaagagcatcagttctgaagctgctctactaggttcacattctatttccatcagcacctgtgagaacccagtcaagctacttaatctctcatgcctcagctccctcatctgtaggacagagaagttcctacactgcaaggatgttatgaggattaaacaacaatatctgtaaagtacttagaatactgcctggcacgtagcaagtgctataaaagctttcgtcaaactaataatattaaaattagtagacataattaagatcttaacattgtcacctcaacagagaagagtaaaaaaataaaaagatcttaatactgcataataaagttgactctcattatttctggtagttatgttctatttagtcaatgcgaacacttaattattgagtactgaaccactgctcctaggagaaacgtgtatatatacaatctcacattcatcatcatcttaaatcctaaaaagaactcatcctggcagattctatcttcattattttgtaagaaaagtggttcagaaatgttaagtgactggactgaggctgccccactgacagggattcaaactccccgactggccccagagccacagctccttgcactacatggcactggcccttcctgtctccaagctctaggcatggttatatgaggttaagaccagaaggcaagcctcaccttgttggacttcatgctctgtgcatgtccacaaatgactgtgaaagtgccacaattactgattttgggggttacaaataaattttagcaaatacgtgattttgcaaacatggaatctgcaaatagtgaggaatgactgtacttcagtttctaaaagtgctttcatgtgtatcatttaatcttcgcaacagcccaacaaaggtgtttttattcttgtttttaagaagaggacaccaactctcaaaggagttaaatgactctctggagccacacagctagtaaacagtaaaccttggatgaactccagtaaggtagtaatgaccaacacaaaccttagaaaaacaggactggcaatggcagccaggaccttagtacagttagtcctccagccatgggttccatatctgtggattcaaccaacctgagataaagtattcgtgagaaaaaagtgcttctgtattgaacatgtcgtttttttgcttattattccttaaaatatacagaataacaattatttatataacatttacattgcattaggtataagtaatctagagattatttgaattatatgggaggctatgcataggttacatgcaaatactacatcattttatatgagggacttaagcatcaccgattttggtatccccttgagttcctggaaacaatcccccaggaatatcattttccacaaggaaacattagcttttagcattacaataaaataaacccaaactctcactagaaaagactagttacccagaatacaaattttcattctgaccaatctctttccctacaaaacatagggaagctgataaactggcattcttgactttgagcctgacattaatgactgtgtgtcctgatcatgagacatctctacaggagcagcagcagcatccaggacaatcatggcaccatacagatctcgtccaaaggatatatcgctcataaatggtgcgggcccgatccacctctttgtatctcagctcaaagttgatgtaggagtgccaggcttgctcctcaggctgccactccatccagcgctcaaacacctgccgggcaccggcaacgtttcccaacatttcctccatgtacgtgtacttgtacctgtaacaaaatcacccgaaaatatctgctgtggtttagttcttccattgttgaatgggaagaagattgaagattttacctttcttaaaggttaaatcaaacatgttttgtcatttgtatgtaaatctgaaaaaggatgaaccattggaaaaaaagatttttttttcttaaaagttgcctagttcaacaagaagcttatgaataaaagattgcaatcaaaattttagttttgattacatagctatagaacattacgattatgacttaatagactatgggacataacagcatttatgtctgaagaaaaagtaggatatcaaattaaactatcatcatgtaaataaaataaatacagaagatgtggaactttgctagtctataaaaggctgttttgttagatcagaaacttaccagaactgattaactcgaggcagcgttgttatggcccggtcccagatatttcgagcatggttgacttggcgattcttcatttccatttctgcgtatttcagccagagtgtaatatttcggtagtctacatctaaagcacgctcgtatatggatcgagcccttaagaagcaagatttgcagggcatcaaaaatagagcattcaacacatgtagcagttatttcaaactatctggaatgcactgatgttttattaggtgtctaccatgagccaagttctgggcataaaaaaatgaaaagatataatgctctcaagtaccttacaaagtcttataaaaagacatgcatgcaattataatgcaatgtgatttatgttatagtcaagatctgcacgggaaacagagaggaagaaatgaaaatgtttggtggaaaaggctaagtagtaggtaattgtagaaatgagaacttgaggaacgttccgatttaccaggaaactaagtttggtgaggagggggtgctcattccaggcaaggagaacagtcaagcctcacgataaggagacatgatatattcagggagtggcacatacacaggcacagtgggggaaggaggtatgcggggagaatgcagaaagctagaccacaggaagggccagattgcaatttttattttttttggccattggttttattttttttggccattgtttagctgaaatttgtaaaaatctcaatatatacaaagcaaatgaaattgtgcttctttagctacaactgacaagatctatctctaaagcctcttctgccaccctccccaggactattctaccccagtactcctgaggccctcaagggaaccctagggttccatggaaccaaagttgaaaatttctacccgaggcacaatcttttacctgtgctttaactttttcttcttttctttttggtatctgttaatctatgaatcattatatacaaaactacactctcagtaattttacctttgaatctcctttaggctttcttcccattgtgcgtattttatccagttactaatcacagtcctgttttttcttatattatcttcaaaagtctggaagaaggcaaaaagggtcaagtcaaaagacaaatgactaaaaatgacagcacccttggtctattttaagtcttgtactaaaatggttattcattttgttcatatttaagagaaattacatcctggaatccttgaggaataagaaacccactacagaaggttacagtcaactaactgatactttaaaatggtctatgcttgtccctaataaaaaatgtttttgactattacctttaagtcctctggtaattctcagaatttcatatataacagcattagtgctttaaaacagtcccacattctagagtgaagaggtcaaatcagatcccaaagtcttctcatggtccttttgcagacctcaattccttttcctttctttctttctttctttttttttttttgagacaaagtcttgctctgtcgcccaggctggagtgcagtggcacgatctcggctcactgcagcctctgcctcccgagttgctgtgattctcatgtctcagcctcccgaatagctgggattacaggcacctgccaccacgcctggctaatttttgtattttagtagagatggggtttcaccatgttggctaggctggtctcaaactcctgacctcaggtgatctgcccgcctcggcctcccaaagtgttgggattacaggcgcgagccactgtgcccagccagatctcaattcttaacacagaaggtggtatagacagaagtacacagtgcagccttactaagcataccctccttcttgttgtcagttgttccatctgctaaacttccgctcactttgattcagcatcaaaaattatgcagattcaatttctttacactttaaccagacaactcatggcatattttatatagttcagaaaaatgctgttatctggtaaccagaagtacattattcatgcgtctggaaacacttaacctcatcttgccctacagaatccaaccaatgaggagcttttcaaactgaccgatacagtcttaacaattagtggactgaaagataccacactgactgaccttccttttccttagtttataatcatttaattcttcttcatctgtgatcttctgttgaggtggaggtggaagaagctcaagttctctttctttagcctctcttaagagttgttcagcagttatctgtacctcagccggggctttgtttttcaccttttaagaaagaagacatttctatttttagtagttgctcttcacacaaggcttaagaaacaaacatacattttttaggatatgaactttgttagtattatcacaagatgccctttttgtatgacatgttcccattcctccatgagactgaaaagaaaaaaaaaataccgttttctctcttattcatagtatctactgcaaagccataggtaaaagtctcaagagaaaaaggtggcaaaaataatagcaagttttcccttttagatgagtataataataaactttgaggccgtctaggtaaaattctgaccagaggttttgttttatcaaaatgtgtagcacatcttattaacagcattacaacctgcatttacagaattcttcaacttatttaatgccccggtgtataactgggtttggttttacatggcacttcaagtcaaaggcaatttcagtaagttctcatcattagactgtaagcttcttgaggtcttagaagcttacagtctaacgtagcttagagctgtgctgtccaacacagtagctatgagtcacatgtggtgagtacaaattgaggtggactgtaagtgtaaaatacacattggttttgaagatgaagtataaaaaagaataaactacctcattacattttttataccgattacatgttgaaatgataatattttggatacattagctcaaataaaatatatattatcaaaattaatttcacttttttgctttgtttttactttttaatgtagatatgagaaaatttaaaatttcatatgtggtgtgcattatatttccattggaccagtgatgcccaataaaagtttatgtagctgaattataaaaaatgttacttaatgccacatgtggagtaatgatgataatggtgatagctcatatttaataagcactaagtgccagacacagtgttacttgctctatatgcattactcctgcgagtcagacaaatagttatgtaaaggtccagttcaagagagtcatccgggctcaagaaagactggagggagggtatctgtaaaggcttcaaagtctgccacatattaagcacttggtaagtattagctatcaaaggaaataccagatagtaagtctactgtttaattaacttatgatactatactactcctaccgtctactctcgccctccgctgtcagctgggctaactcctattcagccttcaagtctcagcttaaaggtcatttcctcagcaaaatttactttcaggaccccttcatacgacccccttattcacgcccatggcatattctactttgcctctcggtaacatctagcaaggtcgtctttatacagaaactcgtgttttgagtactgcttgtggccagcgtacgagcgtagcttcccagcgcccagtgcagtgcctggctcagtaaatcttcaccgaaccaccccactccactccccagcaaaaccaccccagaacgaaggccacgccaacgcgggtcgtgctccgcgatgacaagagcccgcgccccaccaccagctgcccttcctctccatctctcagggtgagccttctccccggcgggaacactctctcccaacccgggcaccctcagggctgagggatgcccctttcctaggccacctcctacaaggcccctcgcgatcgcctaccttggccactttgggaatccgctgcttcccggccgcggtggaggccgccatgtctgcagcagtcgacctctggacacctgtccccggcacggacgctagaaatcggctctgagagctcaccgaaaccacaaagctttcagaaaacaaacaggatctcggaaccggaagcggaacttgcaggactgacctttgacctctcgcttgagccgtgacggaggcggcaccgtttccatggtgaccaggctgcgcgtcctccttgcggcagcgcgtggagtgcggcgtcctggagctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagtaagaacggagctccaatctggatgctcgagggcgggggaagaagggagagcgaggaaactaccattcccagcatgcgacggggcgagctgccgcccttttaggctgcaatgcctcgagcattgcattctagtagtctctgggtccacgccccctcgtttctggtttcgggacagttgtgcccaaataattctaaggtgcccaaataattaactctaaggcttggaattaaaaataacagaaggtactttgaagccagatattaggaaaaaatataaatagagtaactggaaaacaactcagtcttgtgataagaaacatgtttaaattctgtgtgtgccttaattactctagttaaattttcttagcctcaatgtcctcaactataaaacaaggctaataacatctgtttcactaggattaaagacaaatgctcagtagatgttagctgttataatacttaacctgccctcaaaaactgaaaagcaaaggttaagagaattttttttaatagacatttttagagaagttttaggttcacaacaaaattaagtggaagacacagagatttcctccctccacagcttcctgctatcaattattgtacctcttccctcctctaacagcctccaactcttaaaaatatcctccaccagagcagtacatttgttacaatcttgaacctacattgacacatcattatcacccaaagttcatagtttatattagggttcactcttggtgtacattctatgaggttggacaaatgtataatgacatgacttggcagctcatttgttaggataatttccacagttgcaaagctcttttggtgtttggggaaaatatatatttatgtatgtagtaatatcacgtctaccaatgcagatattactttcaacaaaagatttatgcagatttctagaactgcagtcagttataaccaacatcaatgtatttgccataactctttattaaccatattatttagatattttatctcacttttcaaaatttaaatagagaagattttatatcactttcataaagccacctaacaaaataaataaatattaaaaagatgtttctttgaagtgattttccttaaatgtgttactgtaaacaattgatttaccaaatgaatcattggtttaatcatctgttgcctttgctcaaaagtacaaacatgctagaatactttgcttctgatcaccatccttctctcttacatttctgttgtctggcaattcagttcatctctgtgtgtgttttttttgtttgtttttttttttttttttttttaggaaaaatgtattatccttcttactttttgccatcaatgcttttgtagatata

SEQ ID NO: 17 - DNA, 1931 bp, Homo sapiens
acagcattacaacctgcatttacagaattcttcaacttatttaatgccccggtgtataactgggtttggttttacatggcacttcaagtcaaaggcaatttcagtaagttctcatcattagactgtaagcttcttgaggtcttagaagcttacagtctaacgtagcttagagctgtgctgtccaacacagtagctatgagtcacatgtggtgagtacaaattgaggtggactgtaagtgtaaaatacacattggttttgaagatgaagtataaaaaagaataaactacctcattacattttttataccgattacatgttgaaatgataatattttggatacattagctcaaataaaatatatattatcaaaattaatttcacttttttgctttgtttttactttttaatgtagatatgagaaaatttaaaatttcatatgtggtgtgcattatatttccattggaccagtgatgcccaataaaagtttatgtagctgaattataaaaaatgttacttaatgccacatgtggagtaatgatgataatggtgatagctcatatttaataagcactaagtgccagacacagtgttacttgctctatatgcattactcctgcgagtcagacaaatagttatgtaaaggtccagttcaagagagtcatccgggctcaagaaagactggagggagggtatctgtaaaggcttcaaagtctgccacatattaagcacttggtaagtattagctatcaaaggaaataccagatagtaagtctactgtttaattaacttatgatactatactactcctaccgtctactctcgccctccgctgtcagctgggctaactcctattcagccttcaagtctcagcttaaaggtcatttcctcagcaaaatttactttcaggaccccttcatacgacccccttattcacgcccatggcatattctactttgcctctcggtaacatctagcaaggtcgtctttatacagaaactcgtgttttgagtactgcttgtggccagcgtacgagcgtagcttcccagcgcccagtgcagtgcctggctcagtaaatcttcaccgaaccaccccactccactccccagcaaaaccaccccagaacgaaggccacgccaacgcgggtcgtgctccgcgatgacaagagcccgcgccccaccaccagctgcccttcctctccatctctcagggtgagccttctccccggcgggaacactctctcccaacccgggcaccctcagggctgagggatgcccctttcctaggccacctcctacaaggcccctcgcgatcgcctaccttggccactttgggaatccgctgcttcccggccgcggtggaggccgccatgtctgcagcagtcgacctctggacacctgtccccggcacggacgctagaaatcggctctgagagctcaccgaaaccacaaagctttcagaaaacaaacaggatctcggaaccggaagcggaacttgcaggactgacctttgacctctcgcttgagccgtgacggaggcggcaccgtttccatggtgaccaggctgcgcgtcctccttgcggcagcgcgtggagtgcggcgtcctggagctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagtaagaacggagctccaatctggatgctcgagggcgggggaagaagggagagcgaggaaactaccattcccagcatgcgacggggcgagctgccgcccttttaggctgcaatgcctcgagcattgcattctagtagtctctgggtccacgccccctcgtttctggtttcggg

SEQ ID NO: 18 - DNA, 2904 bp, Homo sapiens
tccatgtcctctgttaagaacaaatgaaaggcaatgacacatagtttctattagcctttggttacaaagattcatcatacaaaatcaaaaaacatgattgcctttctagccaaccttcagcccagagataataacttgctcaggcttgaagctacgttaaaatcattcaggactgtggccaagtctgcgctccgatcctagcaatatgttttgtaaactaaagtgattggccattcctcatttactcacccttaacatgtaaataaggaactaaaatttatcctggaaatcaaaatcaaatataaccacagcaaacacaggcacacaaggtgcttttgaagagactattctgtatatacaaatgtattacacagccacagcttggtcaggaaaatcaccacttttcctaaagtcagtaacttcctctctaatttccttaaaacatttttttccttagtaatcaaaatctcaggtaaaaagcccaggaataatagaaaaaaattactattatattgaagaaaattactaatagtattaattcctattactattgacctcagtgaaacacagaatgagagttctagtctcagaagaaactgtaagatcctgtacttcaactccagcatttggtaagtgagaaaaccaaaaggtcacgtgattaattcaaatacacatttaagaaactactgagtcaatgccagagctcacattcattgcttcacaatcacagtctctcaggctcaccttttctgcctgagtcttgtttagtgacttataatgagatttaaaaatcaatacaataaaatcatatcctaacatgtcacatgaacaaaatgtattgtgtggaaggaagaaatttctccccttctgagatcagcagaagaaaaacaaatgctattgcatcttcttcagctgcaattaaacaggagtcctacatgtcagacatattcaccacagtcaccatcttcctctccatgaactggaagaatttcagtgtgagactcccatgatttaatgcaagcaaacctggaattaagttattaatgaatataggaatattaatgaatataggttggttgaagccatgtccttgtaggtgatactcccatgccaatctccttatttgtagagagtgctctctctctctctttctctccctctctccttttttttctttttctttttgtaagaggtggggtcttgctatgttgcataggctggcctcaaactcccgggcccagaagatcctcccacatcagcctcccaagtagctggaactacaggtgtgtaccactgcacccagcttgtttttgaatagttccaacattatagacgaagaaaaatgagactaagaaaactggagtaggctggggtgtggtagcttacctctgtaatgccagcacttcgggaggttgaggtaagcagatcatttgaggtcaggagttcaagaccagcctggccaacatggtgaaaccccgtctctactaaaaatgcaaaaattagctgggtgtggtggcagatgcctgtatttccagctactcgggaggctgaggtgggaggatgacttgaaccagggaggtggatgttgcagtgagcagagattacaccccacactccagcttgggtgacacagtgaaatggatctcaacccccccttcaaaaaaaagtccaagaaaacaccccccaaagaaaattggagtagaaaggtggttgtagatagtaagataatatgaatagcaataaattaatattatgtttatattaatactgaaatatgatttcttagagtactttgagttttaagtaaatgaactactagcttaagaatcaaagaaacaaatgaccatgagatactacttcacatccactataaaggctatagtttaaaaatggacatgacaaagtgtttatgaggatgtggaaaaactgcaactcacatacattgctggtggaaatgtaaaattatgcagaagctgtggaaaataggttggcagtgcctcaaaaggttaaacatacagttgccacacaatccaaaaattccacttttaggtatagttctaagattaatgaaaacatatgtccacacaaaaacttgtgcacaaatgttcatagtgacatcattcataatgtggaaacaacccaaacatctatcaagtgatgaatggataaatacagtgtgatagttctacagaatgcaactgtaataccattcaattataaaaaagaatgaaatactgatttatgtggcaacaaggatgaacctcatacacattatgttaagtgcaaggagccagatataaaaggccacatgtatgattccatttatatgaaatgtccagaataagcaaatccggagatagtaagtactgtagtgattatcaagggttggggaaggaggtgagagggataagggtggagtgactgttttgttggagggatgaaatgttctgggattagataccggtgatgtttgcaaaactttctgaatgtaccaaaaaccactaaagcatgcatacatttttaaaatgtaaattacgtggcattcaattgatatctcaatgaaaaaaaatcagataaaccaggtgattaaagaaagtgagggaaggaatgaaactattgcacattccttgcctggcagcacagggctatatgataacccatgtgaaggaaaactggctcttcgaaggccttgtctcaatattgccaggacagagtttagtcattgccaagtatatggataaaagtaactcagattcaatatagatgataatattaagttctgtttttttcctaggactaataaagtatttttaaaatgcttagatttaggtctgaattttaattcattttcttttaaaaacaaactaattaaaataatcccaaagctttttattattttttttt

SEQ ID NO: 19 - DNA, 6623 bp, Homo sapiens
ccccagattagatcagtccactctcatgtatcacatctgaatgttttataaacaaacacaaaggcaacttaatgcaggagtctgaaagacatacaatatgtcccaaggaagaggtagagaagctgaggacactagttttgcagcactgtaaaaagaagtatcccaaaggattcagaatttcccaggctacagactgactccttggtttactgagacgtcttaaaacggctcttcaaagctgatctcctaattgtgattcttgcctagaatctgatctggtcctactcatttctcttatccagttctagggttttctgggaagacaggagagggaaaaatattgactttcctccaagtgatattaggaatgactaataaaaataatggtgagtcctggaaaattcagagagctgcattaaaaaattaatggcccgagttccttggagtcatctgaaaattaaacaatcacccagagacaaatccaaatttttttaaaaaagcatttcataaagacacagtttattctaggaattttcagtaactgttattgcttttttgtggtagctatgcttcaagtaaggctcatttcgtttcaagcctaacttagttccattgcagacaaggaaaggggacggggaggttatattttcatattatctgattttgtgaaattgctatgtaaaaatgtaatccatttcatgaagataaaaaactactttaaaacatttttaaataaaataaaacgtaaccagtgaaatatggctgcatgattacggggcacagttgaacctaattaccagcaaattacaaaccactccactaaatgaatataaatcctcaacaatggagaagggggctctatgactatatgatatgcttggtactcttttaaatgatacttccctatttgagtaaaacaaagaagaaactgcaaagggatgaggcaggataactgcggctcatttgtcacaaggctccaacttgcttgatttttccctgtgtgtcagagaatgtgcacattgaaagagagggagctctccatcaccaagagagcccaaaaatagcccaactgatcatagccattgtaaaaatattcatggatgtaaggaaagatcctttcccagtctgatgctccttgacttgtgatttgctaaatttgagaagccatcacttacacaacctgttttatagacaaatccttccagtttcagaagaaaaaatgtcatctatctcaacctccatctctttttcaaacttcgatagatgagaagaaaatggtgaataaatttttagaatcagttttgcaagattggtttcaaggaaggaagagaacaggtgaagtggatagagccacacttcccacataactaagggcaagttagttttatcacttttgggtaaagtgttccctatgaggggatttactcctttcataagaaaatcaatctcttcttccaacaaaagctactgaaccacttatgctgttacataaatgtgttaatggggaaatccattcaaacatctgcactaagcactctgtatttatacatatgaatgagattgagagacactgccattcctactgttttagcttccactatagtggaaaagggaaaatatatacaatatactctgatccaaggagaaagaagaaaacttcacaaaatacaaacttgttaaaaaataaagacaaaaagaccaagtttccctggggctgaagctgggttatgggcacagacaaacatagggcctctaagagagtcctgcatgctaggcaatatttagagttcttcctcaccagtagctcaggatgcattcagatgtaagctcgaggagtcacgcagcatctcttggcattattggttgtttgcacatccatgtctgtagctggactgcaaaccattctcaaggtggtaaatattcttccctggggctttgtgcatggtacaccctcagtaaatattaaatgaatggatgtatatctgacactgggcgtgtcaaggcttcggaaaatttacttccactcccataaaacttcttctttaaaaaatgcttgcaaaaataatagataggaggattcaatttgtgtttgcaaccttgagacagcaagctgaggaactggtttgtctgcttgctgcccgtgtccttcctgctcagtggactgattcaaggatttgagtcttcaggatgttaagtgagtgaattaaaaaaaaaaaaaagtagaactgaaaacagtgaaaaatgcctgtcatcagcatcgtaatgactgatcaccatcagccagataattatacaggctgaagatgatttttacaaacataaaacctaaaatagatgcctcaaggttaacacatcctaattatcttttgtataaacatcgtataaacactctatactctatttttaaaggtactgctaaagaaaaaataaaaagaaatagagttaataaagattatttgctatatccagagatatactgaaattccagaataaatcttcctattacattattacctatcaaggtagagcagagtaaaaattccaccaatacaagcatctttgtaaaataacatatttaatatgcacacttaccaaaatattacagtgagaaaatcagtgacaagtatttatgtatataaaatgtgtagagtaagccataccaaaaataaataacagagaaagtacttcaaaaattccatatttgcctactgtttatatacctcacaagaactatacctattaacacacttgagagaagatacatagtaataaaaataggaacgtggtcacactgatggctaatcagaaaaactatttggtgtaaaccagggtcgtcagagtttaagaatttggcaagaaagagaggaagagagaggagagagaagaggggaaagagagagagatagaatatagaagaaatggtttctacttacagctactatctaatcccctggcttttctgaagttgaagccaataatatgtgaatactttaaggatacgtaagcatttgtccaaattagcatgactgatgttcagataaggacataacaaggacacagtgtggcactaaagaaacaaagttgctaataacatacagcttttgcaagtaaactggtttccttcatatcaatcactgtggaaggcttcacattttctttatccaacgatgccatcagtacaaagtccatggtttaggtgtttctttaaattatgctttaagaacctaggacaggtccttcaactgttttcaaagggaaaaaaaatacatcctaacaaagtgaaaacagatctttcaaataatatagataatgaagctgcatattaatgttttagattaaagatgattagtatctattatttcttttgttcagtacctggcatgagagctatctataagtaatcagactttatttatagataaataaaatttataggaagccattcgtttagactgagctcctgcaccaagcccaacagaccaaaccaagatggagtcactcatgctgaaattcctcatcaccaagccaaaactaagttgtttatttgaccttttaagcaatcaggagagactcacatccccaaacagtccagttttaggtactacgataaggaagttcctcctgcattaacctttgcaagtaaagtaactttgaaaagaccaatttgctttttgttttctatatatgttttcctctacccttttctgtttgtaaaaccaaactctgttcagctcattgaaatattcattctattttatagaatgcaaaattgcttgactctagaatggtaaataaaaaacaattaggatcttcaaactaaaatctgttgtaattttgtctttagaattatatctacctgttgggactagaaaaggttttgtgaaggtggtgttttctaagtgggaactaaaaagattggtagaaacaatacaggaaaacacaatagaaaaataatgaagagagtttgcccaaggaatggtaagatatcctttttagttaagtaaagtataagtaagataaacaactagaaatgtactttggggacaaaatgtgaagaaatatgaatgtcaagccacggaatttggactttactcattgttctccaggaaattatgaaagattataaattacgagattggcttgaccacattgttcagataactccacattccaacctcccagctaaggatattgcctcactgtcacctcactgagatggattggaacccctttccctgtaatctgaaactaacataaattatattaccaacagcatcttgtatgtatcacaacactccatataaaaccaacacctactgataagggatggaataacgttacttacttttctagattatcaatgttaacagtcagcgattcattaagaatcatcaaaccttggagttaaagaggctcatatatgcagtgttcaaaaagcaaacgtggaaacaaatgctcactggcaggagagctgattcaccagtcgtacagtcactgcagaaaatatagtccacgtgtttaagcactaaagtttcttttccctcacaagagcacaacttcaagaggaaatgcatgggtaaaatggataaatcccaggcctacacaacaacctagatgaagtctagaaatttagtgctgagtaaaatggacaagtttgttcaagtcatcatccagcgcaaatcacaatgttctgaatgtgttctgacaaggttttagagtgtagattcactacttttttggttacagcttattttaaaatttatgatttcttataaactcacagataaccaaggtgccttatgagaaaatgattctcattttaatgttgttgttgcaagttagaaaacaatacccccaactgaaggcctcagaatccaatctttttctgtccttttcctgtcctcctgcctctcagttccaatttttcctgaggttagccatagaaactagaccccttctttcccaaggtgggtgatagaaaccagaaccccatttccctgaagccagccaaaaaccttaacatattactctaacttgccccctctacctttctgtacaaaaattggctatgaaaaaattatctgacctaccttgtttaactgtaggtaataagattccctttccagagagggtcctcaccacactcagaagaaaggaatacgtactcagaaaggccaagaaaaatctagacagacaggtcttactgagtttccctactcagtctattagcattaaatcatattcgttttgtccaatcatatttctacaggatactgtccatactttgttaaacctaagaataaaaagggacaaattattcccctgcttctttgggccttcattctgaaaggcttcatgtcatgtaaaactgtgatcaaacaaatttatatgcctttttcctctcaatctgcctcttgtcaataattttcagtgaaccttaaggcagcagaggaaaatttttctcttagcccgtatactctccattcattgataaaatgattcactgctgtccctatcaaagaatagattgtttctaagtgaagatattatctcaagtttattcagattttagagatatgcctaggccagaagagagaagccagaagttggtaagaggagccaaatttgaggagcagtcataaaacacttattacttttattgggctgaatgagaaagcattctgtaaagatttctgtccatatgcataactgctgtgattgcaaaaccaagagacacagtaaagacggttttcaagggaaaccaaagaatgatgcttggtctgcagtgggggcagctgtttgatcaatctctatagggtattcacatgaagtttttggtccacaagaggcaaatctcttactatttttaactgggtaactatgagtattgcttgcagaacctacaactgtgttgcagtgctcactactgcttgcatgggtctttacagtgaacattctttcctccttgcgtgtattcagagcacggaagtccaccgcccagcatctgtatgaggatctggctgtcacagtccctgcagctcctatcccgtacacatacatttccctgttttctttttttgagacagagtctcgctctgtcgccctggctggagtgcagtggtgcgatctcagcccactgcaaccttcacctcccgggttcaagcgattcttctgcctcagcctcccaagtagctgggaatacaggcgcctgccaccatgcccagctaatttttgtatttttagtagagacggggtttcgccatgttggccaggctagtcctgaactcctgacctcgtgatccacctgcctcagcctcccaaagtgctgggattacaggtgtgagacaccgcgcccagccacatttctcctttaaaggttttacgctgttaccaatcagtcagcttacctacgttaaagactgaaaatcatcactatgttaacatatattgatgaatagacattatgtatgtaacaggatttttttaaatgacaaactttgactaaggcatcagggaatagatatgaactctaaaattttattccagaaaatatagaaatctgaaaataggtaacacagaaattgattacactgctctaaattctacaaggaagacatagaaag

SEQ ID NO: 20 - DNA, 1517 bp, Homo sapiens
tgaaaaatgtaagccagaatttcactttgctaagaatcgttaaattcaaaatatccttggtaggcattaggcctaaaatctcattgcattttagctctgtaaccctgggcaagtcttttgacctttttaagcaaatatcttgccctacctaacctctcatagaacatatatactgagcaattaccgttttccaaccaccaggttggtacttatcaccacaacccaagaagcaggtacaacagttatctccattttactgataagaaaagtgagtcttattaatgtgggttaagtaatttacttatagtcttacagctaataaatgataaagtaggattagaatccagcccctggcccaactccaaactatatactatatatcctcctactccataattagtagatagtatatactgtactatcttcctaccccataatagtcatttagggtttgaatgaaataacatgttaaaatattatgtaaaggtaaagaattatacaaatgtataatttttgttttataatatctaagattcttgatcattccctaagtataacttttcaaagagtctactgtattcattcttcatgtaaatattttgatcatctattaatcattttcagttttcttgtgactaagataaaattttcaaatactagactgtggaaaagcatacttgaagtagttaaaggtgaacaccggctgaaagaaaaatgaagtttagaaaattcttttaaaaactatcatagtatttaattggtcttcagaattggattactgtttcagtgtaactgttgacttgcataaactcaaaagaaacagtttctcatattccagtaagcatgaaacatactgttggtgttgtcctgatgttatgttatatattttaattcttactaaaagttttctctggttagaacctgctcagtccacttttctgcagaacagacatcactaaggcaaaataaatctccggttgtacatattgatcaaaatatggaagcctaaaagaggcatgctgtttgaaaaacactgtgaaacatcatgcagatgagtgttcttatccaaagccaaattcttcccttcttttagttcttctttttctggatacaggaaatatattcccttttgaagaggcaatatgcctgggcctccctccttctcctcaccagtgtctaaaaggaattattccacttccaaggccacaggagactatatcagtgccatctatgtttagagtctaacaccatcatcctttcagaaggcagcagtagcagctatctcaaaagacagagcagtaggatgggtccctgagcagatgcccacctgtccaaagtcccaggctccatctgagtcaggtgtcattgaaacatatcacccagtgaaagtcacatggagtcttaataatgcagatttagtcaacttctttatttcagatgtccaactaaaaacacctgggagaccttaagcattatctattttctctttcaccaaacaaaatgataaatggaaaaaa

SEQ ID NO: 21 - DNA, 8882 bp, Homo sapiens
acaggtttattctgctgcattcaacatcaagtgagaaaaagttaccctgctttcaataaagtaatgtggcaatagcataggtgaattcaatatttaaggaacaaactgcatgccaagtcaattctttctaggtcgggtccaaacaatactatggagtgcctggtaaatgctggacactgtgcttcctgcctgcttgcactcaccactgtcttattttagactccacaaaaaccttggaagcaacaggatataacccaggtctcttcaactataaatctttatatgttctaccatatataataaattatctttgtgcctctttccagctgtaagcaggagtgaggggtgggagcagtttcagggatctcagtagagatcatatccaacacttagttgtggtttggcacaacctggtggcaagtttcctgctcccactctaatgtccataagagattctaggctcagtgattggctgaaacttctagacacctaacaagctggtaggtatctcaccagcttgacccaaggaggttgggcctgtagaactctggggactccaggacccaatttttttctccccacttactgaggaggggttgcgtgacatttcctgctcagccttatcttgccatccatgaactccccgagcccctcaacacccacaaccagcaaaacaacaacaataggtggaagactggggccaatagtcaattgtcttgaatggaggtggggaaggggataactgtatttatagcaatgtaatattatgtctaagagtttagcttcaccgatgaaaccccatgattacttatacttagtcgaatgtgtttacatacatttagttgaaatctagcaacatatctaagaactagtgaagaaagcatacagtagtagcagtaataatatatgaagagaaaatattgtattgaaaaaatttttcaaaagaaaataacttgacactggaaagtggggaatagtccataaaagaaaaaaatcattgttataatgattactaaacataaaaattaaccaagtgtacatgtgaaagccaccatacacaaactgaataaaaaggtatgagtctttgcttcttgtgcacttgtgatttttcaggggggtggggatataacccagatgagacaagcatgggtaacaagcaggtaaatcacatctcctaaaactgaagacctggaacaaatgaaatactgaagcagacagtatattaccctacactggatttctgctcatgagcttatgaaggctctggattcctgcttatgagctacctaatgaactctggaaatttacgcaagttaatttctctaaacctcaatttccatatctatatatgggccataataatatccatctcattggttgttaccaatgatttaatgaaagaatgtaaataaagaactcagtatagtacctgacaaatagtaaatgtagttatacaatcagctattgttattgatcttaatataattaaatcattccaaaatagtgcttggaaaattggtattagtgtctccagaaagagcttaattgcctctgacacagtctatgttgcaatataactttgcctgaactggatagcaaggaagaagccagcaaggaaggctctattttcctccagaagtgggtatcaaagactaaatttcatcctctcatttttgtagagaggctttagtaaatataaatgtaagtctaggtaacgccatagagatccatttgtttatgttggaaatgtgcatatgtcctgctgcagactagaccacactcatttttactctttaaaaaaatcattcaagtcttgttaaaattctttctattaaactgctgacaactgtacttcttgttagtgtggtttccatttgtacacatttccccctgtgtctctacattataaacctaataatgtattattttagaaagagtctaacatgataattcttacacttttttggaatcactgaccccggggggtctactcagaatatatatatataaaagctatagtttaaagcaatttatgaattgaattaaatctctaaggttaatgccagcaaggcatttgaagggaaagtgctgctcataactgctccatctagcatttctgttaatgaaaagacattaccttctggtagtaatggagccacttaatcctcaatgtagaacttggtaagagtggtactcaaaacggttaccagttagttctgcagggtcatcaatcagaatgaatgccttgtgatcaagcaagtttctagaggcccccacttattctaggagtggacccactttattgctgggctgtggagcgggcactcctggcagaggttgtggtggtagtaggagggtctttgaacagcagaatatggatatattgtaatattttaacaagcatgacagctaaatgtcagccttatgtttacatataataacaaagaaataaattcatgccgaaaatcaactcaagatactctcccaggttgggcatggtggttcatgtttgtaatcccagcactttgggaggctgaggcaggaggatcagtggagcccagaaatttgagaccagcctgggcaccatagtgagaccctatcactgtatttttaattttttaaaaatttgccagatgtggtggcacacagctgtagccctagctacttgaaaggctgaggcaggagaatcgcttgagttcaggacttcaaggttacagggagctatgactgcatcgctgtattccagctgggtgacacagggagaccctctttctcatcatatatacgtaatctctctcaaatctgaaaatgtgaggaaaaagaatttctaattctaaaactttgggcaccaccttcttaaaacatgggtgaaaaagacaaataatacttttatttttgccttcacttttggttacctaatttagttatttcatcactctatagactttctttgatcatctatgatttccttgtattttatagaagtttttaacaacaggggcatatttaagaatccaggccgggcgcagcagctcacgcctgtaatcgcagcactttaggaggccgaggtgggtgaataaccaggtcaggagaccgagaccatcctggctaacacggtgaaaccccgtctctactgaaaaaaaaatacaaaaaattagccgggtgtggtggcgggctcctgtagtcccagctactcgggaggctgaggcaggagaatggcgtgaacccgggaggcggagcttgcagtgagccgagatcgcgccactgcactccagcctgggcgacagagcaacaatccgtctcaaaaaaaaaaaaaaaaaagaaaaaaagaaaaaaaaaattcagcatctggataaaaaattaaataaaattaaaacagtaatgatgttaggaacaagaaagaaattcttttataaaacagtggcatattaaagaattcagcatctggataaaaaaattaaataaaattaaaacaataatagtaacgatgttaggaacaagaaagaagttattttataataatgctaatttttgtgttttagactttacagtgttattttacatatatcaactcttttaatccatgcaacatcctgggataccagggttattattcctactttatacatgaagatgttaaagctcagaaaattaactcaaattaactcaccaaggctatacagctagaaactgggagacagtatttatacccaggtcttcttatttgagttcactttccactacattaaagcacgctggaattcctgggatttttctttaggtgagaggtaaattagtaattataatgtttgttctagagagtaaaagaatgaaacatattatcatcttaccttattacctgttgtatgtatttgtgaccacttcttgagctccataacagaatactcaagtgctgagactaatagggatgtgtgtgacagaggtcgctagaaactgtatcagcatggtcaagaatttcacactttattagcttattttaagcttatttttaaggcgtggtggctcacgcctgtaatcccagcactttggcagtccgaggcaggtggatcacaaggtcaagagatggagaccatcctggccaacatagtgaaaccccatctctactaaaaacacaaaaaatagctgggtgtggtggtgcgcacctgcagtcccagctactcgggaggctgaggcaggagaatcacttgaacccaggaggcgaagtttgcaggaagccgagattgcaccactgccctccagcctggtgacagagtgagactccatctcaaaaaaaaaaaaaagtcctaaaattttttaaaaaaagaaaacaactgctactggattgtataacaccattttatacgagcaggttgtgctaaattgtcagaagatataaaattcttaaagacttgcaaatcacaatgttttggaatggaaaagaaagttagctaacaagaggaaaaacactgcctgctccatgagtaggtctcatcaaattctatcaacttatttctaggcttaaatctcatcagcaagtccaggatgtctgatatagaacacccattatgtaagtcacactgaaaccctataggattcatgggatggagggaggaaatggacagtcaaggaagagtggagtcaagaagtagatgaaatcccccaaactcactgaatgacactaatcgaagtaaggtcccctggcaatctcctttagtccctcactttacataaagagtgactgatgctcggaggacacaaatcactttcttaaggtcacacggtaggaggacttttcagagaaaatgacaatttttaggagaaagactatgcaagcaagtaatatattttatggaaaaagaagagggaagaatagtgattgttcagcacctgtgagagaaactcttatcttccttctctaccaagatggaggttggtattgtttttactactacacagatgagaaaaaaatgatcttgggagattttttttaattgctcaagggccactggactctgaagtggtagaatggggatcccaaccttggttcttctctctcaaagtcctttgctctttccaccctaccaccatatttaacctaaaactcaggcttcagatatcaaattcatgcattaatgagtgtaaaactagacaccatagtgattcattctagaaccagtatatgtatggaaccagggaaatatataaaatcagaacacagataaagagaaaaatttcaaaccatgaaaaaaatttgtaaagcctaaactgcattgcacattgtcatactttatagatagttaattcattcagaaaacatacatagttctcaggaaattaaattcctacatttcgaattcatttatccctatttttttgtgaacatatcagtagaactgcagataatcagaaaggtttatgaacacttgaaggtttttctttttagcaggaaaacaatatttttcagcagaacaaataaatgaaattatgtaggtaagtatttattctgaatcaaaaaccccatagaagtcaagtgctgcccaaaaattatcaacagaaattatttctacatccatctttaaaacgaatgacttccttttgcttcaaggccaaagatggaggtttggatcacaattactcatgttccactcctctctgtaccacacatctagcagataatcacatggaccttgccacattttcttgaattatggattttgtgaaatacagacttcttggccttagattttaaacctctcaaaagtggcaccatcaacttaagtttctgtcccaataaaacaaacaaaaaaacagctccagccacagtgatgacctgatagcttgctgttcttgacataaaccttgttctgctcccccttgctcacacagttctctgaatagttctctctctccctcttcctcccatgcatatcactttctaacaaaacaccaaactgtctgtctcctcaaggggccttgccttcctcagtccaatcaggtcacctctcttcattttctattcatatgctttgctatctcgtattggaaacaagtagtgtgagtctaagataaagtcagtgaagaaggcggtatctatggagaccaggcaaaacccagttccttcataggcacagtcggaccaaagcagcagtgttgctctaagaagtgtcttctatccgtcttctacttgagtgctcctggggattggaagtttctaattagcccttttgatgaccagttggagcactcttacatacattttttaaaaatagagactcaatttgtcatcatgagagaatctttcacttctggacatgctcggctcccagttttaatgccttaaaacagctgccagtgaaggaaaagagaagaaatgagaaaggtgcttattgtttttcctaaaggactaaaccagaaagtagctaagtggtggcactgaggaaaaagagacaggaaataagctggttgtggcttatttataatctggttccaatggagttcaggccaaggcccatcaagccctttacctcaacaaggccctacagtgggctcaggctgaagtcttctttctcatgcatcatttactcataaggcaaaaagatatttagtacccaacataagcaaggcattgtgccagacactgaggtgagtgacaggaaaggggatggtatagttggaaatgcttacgtggcaatagaaagtccaccatgtttagaattaaaggaactgtaattattttctgcacaagcccttcacgttatagatggagaatctgaagactttggggaaggatgggtggaagggtatgggtagagggaaagctgggactagattattcctaccacaaataaaattggaagctaagcattttttttctttttttgccacagtacataatctcagtggtttaaccagaaaaaaaaattataagaaaaactacttataagtgactactcttgctactctgttttgctacaggctgtgtaggcaatacaaataggttaggcagggggaaaaaaaaatctctattaggacaagtagccctgtatacctggatacttttacctagttcaaaattctagaattataattgctccccattcaactcgggcctgatagagtaaacagacattttgtctgaagttgttttatcagtattgtcttgttgatgaagattgcacacattttacaaagctctgttgggataaaccctcctttttgggagaagagattatgtcttcgttatttgcccctgtctttgctggtgtacactgtagcacatttcagactacctggttctaggtattggaatccaatcttatttgtctactgccaccagcatctctggccctttcacgggtcctggtaaagtggtatttgcaaactgtgtcctcctgatcctagtcacagatccttcttttctgctggttttttcccctcctatcgttgtttctttcttagggttatgggaaacttttagttgttcaccatgcgggatgcataggaatttgagaagcaacactcttgtccatcttcccaagctcctcgcccagttgttgctcctctaccatcataatatcatgcaggatgcaggatacttcacagggcatagttgtccttgcagaaaaaaacaaaacaaaaacaaaaccactttccagaattccctcaaatttctccaagggtctccatcttctctttatctccagagcttggtatcaagcaaagggaagaggggttgagcatttcatggagactcagtacacctcagctcgactcatagctcctctagtgctatttcctgcccattaggcacaaaattgtctgctttgatgtcacacgtttctgactgactatgataaatacatacagaagctgataattcctcacctgcctgccattacaataatggtctgagccaccatcatcctccacctgtactactgtgattgcctcctcactggtccatctgcttcctcttttgattctctagaacctatattcagaacagcagccatgtgatccctttaaaatgcaagtaacatagcatcattcttctgttccgcaaaatccttcattggtttccccttcattcttaataaaatccaaagctctgatattgacccaggaagccctatattatctgcccttcctgcctcctctctaacactctgctcttttgcctcaggcctctgcacaagctgtccccattgcttagactccagatatctttttcctgactgccttcaggtctggtcaactgccatgcacctgcgtgaccctcttccctcatgatcatacgtagaatagcaaccctatgccctctgtgaccctcttctccttctctctgcctcttcttccccacagcacttattatcacctgacatactatttgtttatttgctgatatatgctcatttccacccattggaacataaactccatgagaacacattattttgtttgctactgaatacccagtgcctggcactttacagatactcaataaatgtttgtaggatgagtgaatgaatgaatgaacaaactctaaattgggagttcaccaaactttgaatctttattagcaaagtcaatctttggaactaaacaaacaaacgaaccgaaaaacaatctcacaagaagcctgcattgggtttcaaaattattttttctgcggtgcacttttaaaagttcatttttcaattcaaagctaggcattgatttctttgttctgggttgcttctgccctccctctgaggcttgaaagatactggctcaaacggtagaaggctctggaacaaaggaaaaaccaggaaaaaaaattcctctttttataaaaatcctcaaattgcattactctgcctgagaatattgtaataaggatttaa

SEQ ID NO: 22 - DNA, 9536 bp, Homo sapiens
aaaagacattaccttctggtagtaatggagccacttaatcctcaatgtagaacttggtaagagtggtactcaaaacggttaccagttagttctgcagggtcatcaatcagaatgaatgccttgtgatcaagcaagtttctagaggcccccacttattctaggagtggacccactttattgctgggctgtggagcgggcactcctggcagaggttgtggtggtagtaggagggtctttgaacagcagaatatggatatattgtaatattttaacaagcatgacagctaaatgtcagccttatgtttacatataataacaaagaaataaattcatgccgaaaatcaactcaagatactctcccaggttgggcatggtggttcatgtttgtaatcccagcactttgggaggctgaggcaggaggatcagtggagcccagaaatttgagaccagcctgggcaccatagtgagaccctatcactgtatttttaattttttaaaaatttgccagatgtggtggcacacagctgtagccctagctacttgaaaggctgaggcaggagaatcgcttgagttcaggacttcaaggttacagggagctatgactgcatcgctgtattccagctgggtgacacagggagaccctctttctcatcatatatacgtaatctctctcaaatctgaaaatgtgaggaaaaagaatttctaattctaaaactttgggcaccaccttcttaaaacatgggtgaaaaagacaaataatacttttatttttgccttcacttttggttacctaatttagttatttcatcactctatagactttctttgatcatctatgatttccttgtattttatagaagtttttaacaacaggggcatatttaagaatccaggccgggcgcagcagctcacgcctgtaatcgcagcactttaggaggccgaggtgggtgaataaccaggtcaggagaccgagaccatcctggctaacacggtgaaaccccgtctctactgaaaaaaaaatacaaaaaattagccgggtgtggtggcgggctcctgtagtcccagctactcgggaggctgaggcaggagaatggcgtgaacccgggaggcggagcttgcagtgagccgagatcgcgccactgcactccagcctgggcgacagagcaacaatccgtctcaaaaaaaaaaaaaaaaaagaaaaaaagaaaaaaaaaattcagcatctggataaaaaattaaataaaattaaaacagtaatgatgttaggaacaagaaagaaattcttttataaaacagtggcatattaaagaattcagcatctggataaaaaaattaaataaaattaaaacaataatagtaacgatgttaggaacaagaaagaagttattttataataatgctaatttttgtgttttagactttacagtgttattttacatatatcaactcttttaatccatgcaacatcctgggataccagggttattattcctactttatacatgaagatgttaaagctcagaaaattaactcaaattaactcaccaaggctatacagctagaaactgggagacagtatttatacccaggtcttcttatttgagttcactttccactacattaaagcacgctggaattcctgggatttttctttaggtgagaggtaaattagtaattataatgtttgttctagagagtaaaagaatgaaacatattatcatcttaccttattacctgttgtatgtatttgtgaccacttcttgagctccataacagaatactcaagtgctgagactaatagggatgtgtgtgacagaggtcgctagaaactgtatcagcatggtcaagaatttcacactttattagcttattttaagcttatttttaaggcgtggtggctcacgcctgtaatcccagcactttggcagtccgaggcaggtggatcacaaggtcaagagatggagaccatcctggccaacatagtgaaaccccatctctactaaaaacacaaaaaatagctgggtgtggtggtgcgcacctgcagtcccagctactcgggaggctgaggcaggagaatcacttgaacccaggaggcgaagtttgcaggaagccgagattgcaccactgccctccagcctggtgacagagtgagactccatctcaaaaaaaaaaaaaagtcctaaaattttttaaaaaaagaaaacaactgctactggattgtataacaccattttatacgagcaggttgtgctaaattgtcagaagatataaaattcttaaagacttgcaaatcacaatgttttggaatggaaaagaaagttagctaacaagaggaaaaacactgcctgctccatgagtaggtctcatcaaattctatcaacttatttctaggcttaaatctcatcagcaagtccaggatgtctgatatagaacacccattatgtaagtcacactgaaaccctataggattcatgggatggagggaggaaatggacagtcaaggaagagtggagtcaagaagtagatgaaatcccccaaactcactgaatgacactaatcgaagtaaggtcccctggcaatctcctttagtccctcactttacataaagagtgactgatgctcggaggacacaaatcactttcttaaggtcacacggtaggaggacttttcagagaaaatgacaatttttaggagaaagactatgcaagcaagtaatatattttatggaaaaagaagagggaagaatagtgattgttcagcacctgtgagagaaactcttatcttccttctctaccaagatggaggttggtattgtttttactactacacagatgagaaaaaaatgatcttgggagattttttttaattgctcaagggccactggactctgaagtggtagaatggggatcccaaccttggttcttctctctcaaagtcctttgctctttccaccctaccaccatatttaacctaaaactcaggcttcagatatcaaattcatgcattaatgagtgtaaaactagacaccatagtgattcattctagaaccagtatatgtatggaaccagggaaatatataaaatcagaacacagataaagagaaaaatttcaaaccatgaaaaaaatttgtaaagcctaaactgcattgcacattgtcatactttatagatagttaattcattcagaaaacatacatagttctcaggaaattaaattcctacatttcgaattcatttatccctatttttttgtgaacatatcagtagaactgcagataatcagaaaggtttatgaacacttgaaggtttttctttttagcaggaaaacaatatttttcagcagaacaaataaatgaaattatgtaggtaagtatttattctgaatcaaaaaccccatagaagtcaagtgctgcccaaaaattatcaacagaaattatttctacatccatctttaaaacgaatgacttccttttgcttcaaggccaaagatggaggtttggatcacaattactcatgttccactcctctctgtaccacacatctagcagataatcacatggaccttgccacattttcttgaattatggattttgtgaaatacagacttcttggccttagattttaaacctctcaaaagtggcaccatcaacttaagtttctgtcccaataaaacaaacaaaaaaacagctccagccacagtgatgacctgatagcttgctgttcttgacataaaccttgttctgctcccccttgctcacacagttctctgaatagttctctctctccctcttcctcccatgcatatcactttctaacaaaacaccaaactgtctgtctcctcaaggggccttgccttcctcagtccaatcaggtcacctctcttcattttctattcatatgctttgctatctcgtattggaaacaagtagtgtgagtctaagataaagtcagtgaagaaggcggtatctatggagaccaggcaaaacccagttccttcataggcacagtcggaccaaagcagcagtgttgctctaagaagtgtcttctatccgtcttctacttgagtgctcctggggattggaagtttctaattagcccttttgatgaccagttggagcactcttacatacattttttaaaaatagagactcaatttgtcatcatgagagaatctttcacttctggacatgctcggctcccagttttaatgccttaaaacagctgccagtgaaggaaaagagaagaaatgagaaaggtgcttattgtttttcctaaaggactaaaccagaaagtagctaagtggtggcactgaggaaaaagagacaggaaataagctggttgtggcttatttataatctggttccaatggagttcaggccaaggcccatcaagccctttacctcaacaaggccctacagtgggctcaggctgaagtcttctttctcatgcatcatttactcataaggcaaaaagatatttagtacccaacataagcaaggcattgtgccagacactgaggtgagtgacaggaaaggggatggtatagttggaaatgcttacgtggcaatagaaagtccaccatgtttagaattaaaggaactgtaattattttctgcacaagcccttcacgttatagatggagaatctgaagactttggggaaggatgggtggaagggtatgggtagagggaaagctgggactagattattcctaccacaaataaaattggaagctaagcattttttttctttttttgccacagtacataatctcagtggtttaaccagaaaaaaaaattataagaaaaactacttataagtgactactcttgctactctgttttgctacaggctgtgtaggcaatacaaataggttaggcagggggaaaaaaaaatctctattaggacaagtagccctgtatacctggatacttttacctagttcaaaattctagaattataattgctccccattcaactcgggcctgatagagtaaacagacattttgtctgaagttgttttatcagtattgtcttgttgatgaagattgcacacattttacaaagctctgttgggataaaccctcctttttgggagaagagattatgtcttcgttatttgcccctgtctttgctggtgtacactgtagcacatttcagactacctggttctaggtattggaatccaatcttatttgtctactgccaccagcatctctggccctttcacgggtcctggtaaagtggtatttgcaaactgtgtcctcctgatcctagtcacagatccttcttttctgctggttttttcccctcctatcgttgtttctttcttagggttatgggaaacttttagttgttcaccatgcgggatgcataggaatttgagaagcaacactcttgtccatcttcccaagctcctcgcccagttgttgctcctctaccatcataatatcatgcaggatgcaggatacttcacagggcatagttgtccttgcagaaaaaaacaaaacaaaaacaaaaccactttccagaattccctcaaatttctccaagggtctccatcttctctttatctccagagcttggtatcaagcaaagggaagaggggttgagcatttcatggagactcagtacacctcagctcgactcatagctcctctagtgctatttcctgcccattaggcacaaaattgtctgctttgatgtcacacgtttctgactgactatgataaatacatacagaagctgataattcctcacctgcctgccattacaataatggtctgagccaccatcatcctccacctgtactactgtgattgcctcctcactggtccatctgcttcctcttttgattctctagaacctatattcagaacagcagccatgtgatccctttaaaatgcaagtaacatagcatcattcttctgttccgcaaaatccttcattggtttccccttcattcttaataaaatccaaagctctgatattgacccaggaagccctatattatctgcccttcctgcctcctctctaacactctgctcttttgcctcaggcctctgcacaagctgtccccattgcttagactccagatatctttttcctgactgccttcaggtctggtcaactgccatgcacctgcgtgaccctcttccctcatgatcatacgtagaatagcaaccctatgccctctgtgaccctcttctccttctctctgcctcttcttccccacagcacttattatcacctgacatactatttgtttatttgctgatatatgctcatttccacccattggaacataaactccatgagaacacattattttgtttgctactgaatacccagtgcctggcactttacagatactcaataaatgtttgtaggatgagtgaatgaatgaatgaacaaactctaaattgggagttcaccaaactttgaatctttattagcaaagtcaatctttggaactaaacaaacaaacgaaccgaaaaacaatctcacaagaagcctgcattgggtttcaaaattattttttctgcggtgcacttttaaaagttcatttttcaattcaaagctaggcattgatttctttgttctgggttgcttctgccctccctctgaggcttgaaagatactggctcaaacggtagaaggctctggaacaaaggaaaaaccaggaaaaaaaattcctctttttataaaaatcctcaaattgcattactctgcctgagaatattgtaataaggatttaaatggttttggtcttactttgtctagacactttcattcttagtcttgccttgaattgcttaaatattaagagggtaagcagcttgtcggttagagtaaagttatgcaaaaagagcaaatctgctaaaattttccaaagaacgtagtggagctggggcttgaaatgtctggtaaggacatttgaacaggagactgcctattttcaaaagttggataacaggctttgatagtgaaacacggggtgcataactggacacaatggataaaatgaatagaatgagtgtcatcacatgatgaatgggctagttttagagtccacacattcactcaataatggttttacctggtttgcaaggtggcaatccacagttgccagtcctcaagcacactttatttagcctatatttgttaaagaaaaaatttcacatataaatcttgatctccattttcctttaaaagtagaaggtctgccacacttgcttgttaagaaaaaatcacccaggccttggaaataagacaaaaatgagacaaagggactacagcatgctcattcagtcataatagaatattgtctaaaaaatctgctgctatggtttggatatgtcccccaagtttcatgtgttggaaacgtaatccccaaattcatacgttgatggcttttggagatgaggcctttgtgagataattaggatcagataaggtctgatcctaaacagagttgggcccccatgatgggattggtggttttataagaagagcaagagagtcctgagctgacatgctctcgtcctttcaccatgtgatattttctgccatgttatgatgccgtaagaaggttctcaccagacgcaacccctcagtcttagacttcccagtctccagaactgtaagaaataaatttgtttataaattgccgaatctgtgatattctgttacagcaatagaaaatggactaagatacctgcctaagactcatacaattgtctaggccctagactctagtgatgcaatattgttacatttactgtgtactactgattagagttaaaagtctataaagttagatgccaacttgtagaagattgagtgattgtaaattatttttgtacaatagaataaataactccataggtaacagttttgtttccttgtagggtattaaccaattttttaactaactttattttctctcagtattcttatttctgttgactgtataaatattccagcctctcattttctcctttgaaccagctgtcatcttactaaattcttattatgagttaaattaatctttgacacgttcactgtatatttgtaagacagtcatgctttctttcagcttttggaaaattatatttggacctgcttcacattcctaaatgggaaccaatgtctagaataatcactagctgctcccattaagcaagggcagctctccaattcaacacagtttcctcctcccactcctgataatcttatttccagtcctttccctcattcatgtgtccttcttggcctcggtgagcctttgagttcttaacgtctgacttataccttgaggttttagtagagcagtggttcttactcttgaacatgtatgaaaatctccaggagggcttattaaaacacagattgctgggctacaccccagagtatctgactcagtaggcctggggtgagactcaagaattcgcatttctaacaatttctcagatgatgctgatgttgctagtgcagggaccacacttggaaaatcattgttgtagtaagtggtaggctttgaacttggtcttggtagattagaaggcatttttcactgtaacaatttgacaagttgaatgcaagacatagtaaagtaagacttatttttaaaaaactttgaaagccaagcacagtggctcacacctataatcccagtactttgggaggctgaggtgggtggattacttgagctaaagttcaagaccagcctgaccaacatggtgaaaccctgtttctaccaaaaatataaaaattagctaggtatggtggtgcacgcctgtagtcccagctacttgggaggctgaggtgggaggatggcttgagccagggaggcgggggttgcagttagccgatattgtaccactgtactccagcctggtgacacagccagaccctgactcaaaaatataatataatataatataatataatataatataatataatataatatactcttaaaatgtgaattacaacatattagataatagcatttctcatgatgcctactctacttgagaattaactgctgatgatattgaaaacaatgagtaatttttgtaaatttattgaaacgtcaagactgttcaatgactactttttttgtttgtctacattttaacttctttgaaggcaaagaaatcctagtagcctcctcagtgcagtgtctaacgtaggctaatgctatggacctggcaaacacctattgacttacaatgatacatttctatgtatgactgtggtttcctaagcttttcatattcattatctcattcaacatatacaacaatcctgtgaggtgaatagggtatgtgtattactctactttacagataaataagctaagttttagaggcttgacatgtctttccctaggatacaaagcaaatatatggcaaagccagggctagcacttgatctttagtcttgctcaccaggattatttactgacacacaatgaaaactagattaaaaatgccatgaggatttaggataagctaaaagattcttaaaatg

SEQ ID NO: 23 - DNA, 108287 bp, Homo sapiens
tggcttgaaaattaaatgaaacaccaaaatgtgcttgatttacttataggaccctaggaaaaacacttattttcaaaagggtaccttcaatcctgagagaggatatttggcttaaaatgagaatgactactattatttaccatgtgctgagaaataagtgagaactgagtaaaagccaaagaaaaataaatacattggagattaactttactattatgaaataatggaatatttatagaattagtctgataagaccctcacctagggaggtataaagtagtagaaagaggacaaaagcaggagttcagaggacatgaattaaaactctccaggcctctggtgtaattgggagtaactctcatcagtaacatgggaataaaaaagctgccccatctagctgtactagcccggggtgagacttggatgagaaaaactacatgagaaatatacaatttgttatgaaatgaaatatacaatttgttataactaagttaaaatatagcctacttcagggagtgttcctgcatacttaccagaagaagagcatcactggaatggagttcattgtgggtcatcttcatttccccccactgcagctagctctccaagcatcatgttacaacttggcatccccaatgctcagtataatacatgggatacagcaaatgctccatatatatttcctgaatgattaaccaaaacaatgtcactataaggtgttcctaaggtgactgaagaacatttgttacaagccagtgttacagaaagactcaggcatacttttttgtatttggtatcactacagatgttttgactgttttaataaattaacaacatttcagggacctttaagaagaggaaaagaaatatttaagggctaataaagtttgaaaataacccataaagttactctaaaggatttcctaccttcctctactttcagaatcttattattattttttaactttagccatcaccttattcctcctaaaaatgacctatatcagacttttttaattcaactttttgttttagtaagaatttatatttacctaaaagttgcaaagagagtacacaggtttttgtacattcttcaatgtgctttatgtttccctatgttaaaatctcacataacccacttattttttaaaaactaaaatagaaggcaatttgagcaactcttttgtggaattgtctgagagaattatgcaatatccattggaatggaatagaatattttagttacaatacccaagtcatgaatcactggagtcaatcatgatcagttacaggcatgtagaaatacctgaatgtagaatttgggcttcatagaaaaataacgtttaagtctgagaataacctctgtggatatgttgctttacttgaagcaattcttgtaataatgaacacaaaatatatgactctctgaaaaatgctgaaagaaaagactgagtaattttattcaatgtacattagaaaagatccgaagtgattctgtatactacatacaattgactaaagaagatgtcataattaaaatgaaaaaaattgaaataaacctgcttattgatagaaaaccatatatgttcacacataaattataattataaaaaatgtaaattatatataattatatataaatacatataattataaaaattataaaaatgttaattataaaagtattcattttatttcagctgcatatatgtagatctgtacttatggtagaattatttccttgaaatatagttgtttggatttactatgaacttaatttttaaatattatttgaggttctttatgaagagtagcatactttatctagtaaagacaagaaattatccaagcaaaaattagcacttataaatttttatagtatataaatatagtagaatatatgatatatgaaataaatgaatatggctacacagaaacaggtttctgctaattttttaaccactgaatatactccatataaactcccttcactacattcttgctatattatgcaatgtatataatatctgtggttctaataatcaaatattttaagttagactgcttctgaagttaagacatataatttaataaaggagatctggtgaacatattcaaattacaaaacacttttcccttccttctgctacatttaaaaatattaggataccaagtgattcactcaatgaactgtggttttcaagtggatgttaagtgtgcattacaggcctgacaatgacatcagtggagttccataccaagatatccatctactactcaagggagagaggctgcttgccctagattcactgtatgttcttgatcgagtcacctcacattcttgaacctcggtcaacccatttggagaattaggtgaaagctaagccttagtgagaaacagatgctacatctgagatgagttttcttgtgtaaacaagtaattccaaagtttaattccaaagaaagttgctatgtggatggccatgatacatgacctatatgaaatagacaactgggttaaagctttagaataaatgtttcttaatacaaattatagcatcatattacatctgggtttcttaaaatatttttatctaatttttatttcttccaccttgtttattagatatatactatagtgatttttatttgaaatttatttaatgcttttggagcttattattatttttatctggtaacttatacttctaacaggtcaattaagttgtcaaggtagggggaaatagaacttaaaataggccacttattatctagtgcaagtcagtaaaagttaattcttcttttgggataaaagttaacaatcaacggatttaaagacatgtggttttaaaaacaacagctaagtttgcattttggtttaattcccagtagattacttgtcattttagtaaggtcttacattggaaaacacattgctactaaagatgcagataatttaataagttgaaaagaattcctcaaaggaaagaagagccctcttgagaaatgctagttcaagttgtctgactgctttctctcctctacaactatttgtctgattgaaatagctagaaacatcaaagtaagagctgtggttcctgaaattctccgagcttgccgtagctctaaacttatatttcctgtgttgactccatgtcttgctatcaacggtgcacatttcaaagcttcaggtttaacgtactgtgctttccattacacaactttttgtattttaaactgggaataagtaacatgtgaatcagcaagctattggataatgttgacaattctgtgttagctagtttgtgattctctggtttgttttttggtgttcccgcatttgacattagctaaaggagccgtagcttggcctttgagtggaaaacaatccaggaatttcagagaagaactaagcaacaaaaggcctagagctattatcttctgaagagagatgaaagcactcctgtccttgtgctttcctcggttgcctgcacagagccttttgactttagtgtgaaaagaacataatctgtgctacaatttggccctaggtttctttagaaactaagcgaagtcgaattgagtgagatgcaaaataaccgttggctaaggtacgatcatccttgggagaccaaaaatgtgatgggtatagatctaaaaacttgttggggaggtggtggtggatgatgaaagtctaagtttagacagtatcgagagaaaatatccaatcaaaaaatttactgaccatcttgggaagcaggctggatgaaagcagaaaatggttcatcattttgacattttgaaagtagacttgcatcataaagaatcttatactagtttcatttggagcagttgaattgtaaatatttttccctctaaaattctcatgtgaatggtgtgaactctagaagaaaaaaaaaacaattattcatatagtatgttcttcatatgtaatgtgtatatattcttcatatatatattcaattattcatatatatgtgtttatacataatatgtatatatgataccctcaaatgtacacataatatctctccaggctcttgccaaagaatattattttgaagtgtacaaaagaggagaagcttttcatcccatgaaaggcctgttttcttctagtgcactctgaatcacttacttactttggacctctgacctccttacgattccctggatctggaagtgagattgatgaacacaaagtgggacatacatgtgggagctcttatgaattggagctatattaaaataattagtctaagttttatctggcatagagttcagattctaccattactctgtgatgtaagcatatttaaagaataagggagttataatcgcaaggaaagttgggaagaatgaattcataagttagtctgtggtcctgaaagcttacaataggggaatcaatagtattaaatgtccttttttcttttttttctttttttttgagatggagtcttactctgtcgccaagtctggagtgcagtggcacaatcttggctcactgcaacctccgcttcccaggttcaaacaattctcctgcctcagcatacatagtagctgggattacaggcttgcaccaccatgcccagctaatttttgtatttttagtagagacagggtttcgccacgttagccaggctggtctcaaactcctgacctcaggtgatcctccctcctcagtctcccaaagtgcttggataacaggtgtgagccactagacctggcaaaatatccctttttcaacttcagtgaataaaattgctcttctgaagccaccttcaatggaattaatttttatacttgaataagatgaaacttgaaaggcccaaaagttttgcagagtagatgattcacgacggttgttcatgaaaagtttacagaaaaaaacctttagatgtttgttcagctctctcttattttaagagagactgcaaacaagaaaataaaacaaaacaataaaactccaaataaaataaaagaaaacaggaacttaagtttctactgcaattcttggcagaaggttaaggtagttttatataagattctgaaacatggctttttagttatgtatctatttttgaggaaaacgtttttctgcctatagacatcactgaagtcaacatttggtatatatattatttatgctctgatgttctgagtatatataacagtgagtgtgtaaagtagaataaattttaatttgataaaatgccaatcacaaaagggttttttttttacatcaaggagcttaatctgttaaatatgactggaaaattatttttcattttcttgtggtgtaaatatctaaataactgcatttctaagtgttaatatttttacccatggattttgttctatttagagacttttctttgaagaactcaaagctctttgattagcatctcatccaacaatttttaagtcagcgaatttcaagaaaaacatatgggggataggcaaagagacttctttaagaaaaatgtaatctcataaaaccaacaacttattcccatttttcttcttccccaacattaacagtgatcacctctatgcgccttggaattaagacatggggaaagtgtttctgttaataactgctctacctctgcattgaattgagatagattcttaagtttccattctgtggttcaagaaatactttgtgtgccttagaagggagttaggaatatgaggtgattgttggtttaactagtatgatttcataatgccatctgtttctcttctattttttttactcaaaaatttttttcaggacatcaaataattatgaaaagcattaatggatgttccacatcactgtgcctactcactaatcctgagcatgccctgctctttccttctttatctttttttttgtaaagtacattagttgtgtttgcatgtacagaatctaaccacttctcttttgggaacaaatctctgattttcatttgaggagtcaccattcttccattctcagcccatgtggtttagatggggttactttttccacttggatctatgggttgctatatgcctgaggctctttcattggaacatttcatttctctgactgcagtgagatccatctcaggttaacagtacttgattctgggacttctgatggaggcaatgatttacaaaaagttattttcatcagactgataagttttggtaagatgttattacaaggggggaaaattacctaaaaaggggggcaaaccagaggaaagcagagctgcaatatgtagagggacaactgctgataatatcatttgagtaccttcatccaactaggtaatctgacacatctgaagataaccagtcctggactttttattataaatacttgcctttcaacttttatttatttagcttaatttagtttgaattgagtttctgtcatttgggtcaaaggaattcttctattcacattacattcccaaagcactagtgtttagtatcataaaaacaaaatagcaatatgatgcttatgagacttatctgtgaactaattaaaaactttctgcaatctctaatgtgtagatactgaagaatgtcatcttcataatcaattttcactatcattttattttgaatttaaaatataaactgtcatagaattatagaattttcaagctaattttcaagttcatttcctccaattccttcatattatttgacagtgcagtacaacttagaaagcgttagggtataatgagaggctgtacagcagactaggaagagcacaaatctacacacccacattgttgtttggtagatgagtaatttagaacacattacttaagcactctgagtggcagtttacttaactattgttctgaagatatctggctcacaattgtcactaaatgtggtaattttaattttactattattgtcaaggaacatagctagttaataacattcttgctttgaacacaaggcataaaccaatgtcagtgtggcctttcttgctcttctgctactttaaattagaaaggggagtaacatatgtgtatttgaatctatttatttatttttttaaaaaattgcaggataaaccaaatctaaaataatagttatctgttggggtgagagaaaatagtgtggaaaggacagggatataagctatgtgtgtctgaatatataatgttttatagattaccttacattattatgaaatgaaaattaatccttgaaggcataatgagattcgtgagctttgtatcaatcaggtgcataaccacacaaagtggaaccactcatgtatcttcaaaacacataatttgaccgcacatatctagtggagtacatgaacaaaatgatttgcaagatactcttaaaatcttttcagtaatcatgttgctttgtttgtagaagctatctttcactacaaactgtttagtaacaaacacaaacataaataaatagttttccaactttattggggtataatttgcaagtaaaattgtatatccttaaggtatacaatttgattatttgaaatacgtatacatgtgaagtgattaccacaatcaaatcagttaacactgttaaaagaccaacaggttttatgcctgctgcaccataacagactaatacagcaagacagcagggtttgttagagagaaatagtttaattgcagggcttcaagtaaggagatggagagagcccctaaaatccatctcctggaggagttctgggctagggtttttaaggggatcattgagggtgagggaatgaaaaattgggttgttgattggttgggtaaggggaatgaaatcatcaggatgtggaaactgcattttttggtgagtcagctccttgaaggatccttcaaagctacctggcatcagcagttttgctgatacgcaaggcctcaaagaatatctcacatggaaaacttaagttgcacagctggactagactgctagctgggagcctcaaccatggagaacagctgactgtgctccttggcaagatgggatcaccaacttggctccacatatgagtggggcctcggattggctttctaatggggtaaggcccctggcatagatgtggtaccaccatcaagatacacatgctggtcgctgtgagccctgttccctttctttgtttctacctgacttcaggtagtgtattcctgcaaatttccccactgttttgtaggagaaaaaacaagagattctccttggtgtggtgctgtgcacccgggggagacctgatgtagttaaaatcaaactatttctcttactcttctaatgtggcttttcttggtttttgagctccaagcggggcacctccacctcaccctcaagttataaaattttcataaaggtgtttttgtatatgtatagttatttgccagtcagaatttttgtgaggggttctaaaggcagagaccttttagtcttccatcttgctgaatcactcttgataataaatatttacttagcttacaatcctgcagaatctagctgatatggtctggtcttgctaatgagtatgtagtcagttttaggttggctacatagatctgctcatcttggtgggctcaacctaggagttagttggctatcagctaatctagagttatttggctaagagacacagcagggccagtatggttgtatttttatatctttaatgtcttttggccccaggtagctccagcaaagtagcccaagcatgttcctgtggtaactgtagaagtggaaaagagcaagtagaaacaggcaagttttttttgttttgttttgttttgtttttttaaatcctcttcttgtttcatggttgctgaaatcctatgggccatggcaagccactgggcagagccagaataagaatgaaaaaacactacaagtttacaaagcaaggtgtgtagatgtgagtactggtgaaaaactggggcaatagataacagtaatctaccacagtatttttctaagatcgtcatgtacatggcatagaataaaacaaaggagttatgctaatgtttatgaaatctagagtttttgggatgggaaaaaggagatataatatcaaaaagattaagcaaaaaactattatcttgtatttgaattggatgtatcattataaacttgtaatgtattttagcttcaaaacaagtatgacacatagctctgtctactgaaaaagcctagacatcatgaccatcccagtggcaataagcacactagcatacataatctagtctctaaatttctcagtaaaataaaccatgaatctttgaaaaaaatgtctaacttcaggaaatgtaaaagttgagcctagaatatcttatcgcatcaccttgtcacatcaaacagcaagaaaattatcaacaatgtctgagataaattgtcaaaagaagacaatttgaggatatgtccctggtcaaagttggaaatttgagcatgaattaaaaaatgattgctgtggttttcaaatatcaaagatgcttaaatctataagctcatggtaataccaaatgatactcaaccctgaacttagtcatgccaggaaaccaattcattatttagaaaactggtggtaaataaaatgaagtaattaaaattttatcctgcctttaatatagaaactgctgcagggtaataaactagttattgagaaaatattctctccagaaaagtttcaagtaacagatgcagaataaattataaaattataataccagcattttctaatccttggtaaagtaatggctagaggatgtatatcaatggctgctaacttaataacaaagtgacaatcagaaattatgtgcctcctggtagaagtccacaacaatacttgtgatatcttcttgactaaaaaatcaagtaaaaaataaatgtaatcaagactttagacctaactaccacttagagaaaataaaaagaatagcaataaaatgaaacagcacctcaagaatgcaataatcaaaatctaccctgggaaatactacaagaccaggaaggttgtctctttaacaaatgcattgaagagaaatcgaaaagaagaggaaggagtaatttgtggattaaagagatacttaaactatatggatattattgagataaagatttaaacaatctgtcaaaaaatagagaaaagtcagagaaatctgaacacctattaacacctattaagtatatgatgatataaagggattattgttaattttttaagtgggataatggtgtcatggttacagtgcggtggctcatgcctgtaatcccaacattttgggagtctgaggagggtggattacttgaggtcaggagttcaagaccagcctagccaacatggtgaaaccccgtttttactaaaaatacaaaaattagccaggcgtggtggtgtgtgcctgtaatcctcgctactcaggaggctgaggcaggagaatcgcttgaacctgggaggcagaggttgcagtgagctgagatcttcccactgcactccagcctgggcaacagagtgagactccatctcaaataataataataataataataataataataataaccttatctgttagagatacatactgaattatacaggtatgatgctatggtttgaaactgtccccaaatttcatgtgtggaaaacttaattctcaaattaatatgttgattggagatggagatcttgggaacgtaattagattagataaggttatcacagtggagccccatgatgggactggtggctttattagaagaggaagagagagctgagctgacatacattcccttgtgctatttccctgcgatgccttttgccatgttatgcaggaagaaggccctcatggataccaccaccatgctcttgaacttcccaacctccagaatgataagaaatatatttctagttttttgcaaactacctagtctcaagtattctgttataacaacagaattgaactaagacatatggaataatatcatgtctaagaacttccttcaaaagaatccagagttgagagagtgaagcagggtgtggctgaagcatgattgagccatttcaacaattgttgaaattgggcattgaatatgtaggggttcattttactattttgcttgttcttgttatatgttttaacatttccttattaaacatttttgagaagctatttcaatataatttttatcatatatataggaaactgttgtagttaaaaaatagtctgctcatgattaggaacttgaggtcagcatcagactatttgaattctgtttacttactactgaagggaccttggacaaggtacataaattttcagcacctcaatttagttaggtgtaacatgagagtattaataggatgtacttcacagagttgttatgtgaattataagttaaaatatgtaacgtgatgattagcacagtgtaacacacgtagtgatcactcagtactttttattatgcttattgatgctatcacatatatgtccagctgaatacatagataaagggctgaaggatatatgtaaacttgtaatattggctaccgctgaggcaagaagtaggaatagagagagaagaaagagaagacattttgaaattctatatatttagtcatgataatgcaaatattattagagtgtgcgataattttaagactactaaatattctcaatataaaaacgattttctagaaaattacatttaaaatctttagttgggcaccttgtctgatacccagcactgtccaaggttgagcaatgaataaaacattgtgccaccacctccaaagagcctaaaatctaatagaggaataagaagagtactaaagataactagataaaagaatgtgatataggttctaaaacaatttataaacatagcaatgcaataatttagaatgtgacgctggaccaagttctaccttaaaaactaccaatttaagtgatttaagtttatgcagaaagcttatgttaaggtagagaaacatctagattataaaggagagagtatgagagataataggaaatcactttgtgagtgataggaccattgccaccaccttatcgttacagagattgccattatctgattattaatatgaattcatttgtgtaaaagtcagagtaatgtcaggttgttttggatctctctaagggatactacttgttaaacatgttctatgagaattgtctttgagaggatgccctggcataagccctaatagcagcactgagtaaggcttcaacatatttatattactacattttactgagaggaagggaagatttaaaagccaatgatagctgttggtgttatcacatttaattaaaaatgacaagggtctatttttactattaaacatttcattctgtggacctagtatagtgtatcaaattcttgcaagctgcgtacccagctgaggaggcagcatatcctcctggtttgctgttcctgcccagtggactctggaaaggctcattcatccctggaagcctgatccatatcttagaaagtggtgataatacctatctcattgaggttcacatgcggattacaggacgtaatgcatgtgaaaagttaagcctagtggaaagcacacatcagtgtttaataattgccagaaactgtgtttaattactggctctgcctgccttgaataggaggtccttggggacaaggacagtgtcacatgtactgccatgtccttggtacccaacttcatgaggatataaactgagtatttatttctatttactgtttttagaggtacttgtgttgcaagaagtcccccatggaggaattccatatgtaaaacctctactgtgggaagatttggccctgagaaccatgctgtttcctcctcagattggtgggttcagctgaaaagcataatcctgtcctcactggagacttttttgaaagggtttctgctgcatttatatgggggattgaaaataagggaaatcgaacatatgccaagggaccacattttcccttaagggtaataaatgtaaagtaagtaaaagaactgtgttaaatacatgcttgtctttctcataaaattcttggtcttttgtctgaggaatattcaaaaggtaatgtatcactgtgggcagatcagcctggcctttatttattttctcagcaactgtcttattttggataaaaggcaggagaaatataaaacgtcaggcactaacagggattttattatttattttctgagctctgttatggttgatgttgtttcattttttccattataaatccctttttctcaaggggctgtaactctcccaataaaaagaatggcttcaggcaaacacttgaagcatttgttctcagcttaagaggacttttgtttttccaggtcttgaaaataaaatccattacattctttttaaattacaggagtgttaaagtgaaaaagcccaggaattgctgcttttatatgtgcgctcttaccacctcggctcagaatttctttaagcagcaattctgcagctcctctcaccaccgattatatgagaagcctctctatctatcactattgatcatctgtactgagtccatcggcttcctcagagatgtttacaagtgctgtttgttggttagtttgtgccgggtcatttctttttgcctgatagatgtaatgcctcccagaagaaacaagtccattcagtacatggtcacctttcttcagtgaaacaattcagtggtctgctatccagagggcaatgaagtgatactggaccttgtcatcctgaaggtggagacatgctgataacttcaaaatatccctttctaatttactcccagaaaagtgctgagctgaatcctgggttataggctaaagaaaaattcaggctgaagatgagatcttacagacacatttcagaggctcgctataagtctgaggtctctgcatggcaggagttggagactctggtcaggccagagtagtcctaggtttccggatgtggctggggatgacatctatagcctagtaacatcaaaagtgcccatgtatctttaatattcttttcttccccctttgcttgctagctgagaccactgcatagtgaatattttaaaagcaagatttccaggagtttaacgcctctggaatacaaacacacacacacacacacacacacacacacacacacacacacgctatacattaagtttcctgtagctacttttgtccaaaaagatagcttaaaggagagaatattccatttagaatgtgctgctattatctagacagactatttttaagaatagattaggctgggtgctgtggctcactcctgtaatcccagcacttttggaggccgaggtgggcagatcacctgaagtcaggagttcaggactagcctggacaacatggtgaaaccctatctctactaaaaatacaaaaattatccaagtgtggtggcaggcacctgtaatcccagctgctctggaggctgaggcagaagaattgcttgaacctgggagacagaggttgcagtgagccgagactgtgccactgcaccccagcctgggcaacagagtgagaccccgtctcaaaaaaaaaatagataaatacaagaatagattagagacagaattataaagcaatgacaataaataattatgtgaagaatcagttgtttagaataaaagaaattagattcttatgtcacactatgcaaagaaaaacacagggggattttagaatcaaatataggagagggtctcagagaagacacaagacttttaaactataaaataaaatattggaaatttgactatatcaaagtaaaaatattctaaacaaccatggacctcataaagttaaaagataaacaatagttatttaaaattcatatggccagcacaatattacctaggatacataaagaatatctactaatcaacataaaacagtaggtaaaatagttgaaaatatatgtaaagcatataatatgccattcgtaggagaagagcaaccaataaagttaagaaatatgctacttcacaaataatcaggaactataaatagaaacaaaggagagataccattttacagatgttagattgtcaaagaaaaattcttatgtcatcaaacattactaagatatggagacatggggaacttcatatgctacttaatggaagtagaatttagtaaaaaccagttggagaaattttgacaatagatagcaatgttgaatatttcatgtcctttaaaattcacaaatttcagttctaagtatatgcttttgaaaaactcttgcatatgtattttaagagatgtatgcatgaatatttattgtaacaatgtttgtctaaaggtgaacacctggaatcaacctaaatgttcattcatcgaaaaatgagtaaattaattgaagtatagtcataatgtgaaatactctacagtagttctgcttttcatttcttttatattccagtttcatcatacttttcacaaagtactgtaaccattaagcaccaaaaatgatgtactaggtgatgagagaaaatcaattttgagtagcgaaggcttgagcagtaagaatgcaaagcactagaacaagaaaaacctgagtcaggcgtgatctcatagaactgggaaaaggggttgtcccaattcaatgtatgaataagaagagtcctgcaatggaactatgaagtgaggcttatattagtgtaggagaatcagaagaaaacatggaaggtggactttatctaatatcaatcatctcggcattttcaccattcattcagctctggattaatcatttagcaaaataaacagatgcaccaagaggaaagggtactaaagagtttccctgaactgacctcagttatcatggccaaaagtatttcactacctcccttaactttagtctatttttttttatctttatctgtcatgtttgacttcaattttcattattaaatggtttttttttttttttggcatggtgagtgatcaagtttagaagtttgacttgaaagttttgtcagatactgcatttgtttgagagatactgcatggcttgagggttttgcttccatcacagcacagttgttggactgtgctgaaggcatcagttggcctgaatccagcctggaacttattgattaattcatctcatgtgtttttaaaacctcccatgtggcaggcactgtgatgtcactgaaaagacattggcataatgaaaaggacttaatcctacttcccttcaagtttataatagttgatgtgtcaagctgataagtaaagaggcaatcacaatgcaatgtattaaatattgtgataatctgtttaatcagtactcttagtcatgggtcagacgatgtgtggtagtgacattgacccaaatgtcttctttccaccagaccgagttgattttacaggaaatcagaaaatgaaactgaatttttttttgagaaaaaacaaaagtcacactaggccataattatttataaacatatatatttctacctttctatttggagcagcaattctcaaaccataattgtttaattccaacttctattgtatgtatgcatcctccttgcaaccaaaggtaattatctcaaagcacatgtatctaaaatttggattgggactgctaaaaccactctggaagtgctgaaactacaatacaagaaagaatgagtacaataccagtgtgggttgttaggcataaacaacaagacctgaatagaaacaacatgaatcagtagctgtaactaagatcgttataactttgctacaactgatataaatttatgaatcctcatttaatcttacaattgtttgaaggaacagtttaaaattttctatcttcaaagttaggtttaggttatgggtgggagaaggaggcattttttttgcatccctgagaaactaacactttatctgtatctgtatatctatatcatttatatctatatttcttaactatatctatcttctagttcatccaaattcacagagacttgggctataaataaaagatctgtgtaatactttaaattgtccaaacattttttcatttattatgataggtaaaggtgagtctgactcttaaaaagtgaggaaagtgaggcttggagatattctatgactctcccaagatcatacagctatttagtggcaggatgaggaatgggccttaatggtttttcaaatgtgcctgaggaaccccattattttttttgagagtccccctctgcgctctgtcatcacccaggctggagtgcagtgcctccttctcggctcactgcaactgccacctcctaggttcaagcaattcttctgccttagcctcccgagtagctgggactacaagtgcccaccaccacacctggctaattttttttttttttgtattttagtagagacagggtttcactctgttgcccaagctggtctccaactcctgagctcaggcaatccgcccacctcgtcctctcaaagtgctaggattacagtcgtgagccacagcgtccagccccaactcagttttaagaggacattctacagctttcgttagtatagtattttgtacttacgcagtagtattgatatggtagtattgatatgatatggccgcttcccccatgctgctcttgtgatagtgagttacttctcaagaaatatgatggttttataagaagctcttcctctttcgctcctcactcttctctctcctgccgccttatgcaggaggtgcgtgcttcgccttctgccacgattgtaagtttcccgaggcctctgcagccatgcagaactgtgagtcaattaaacctctttcctttataaattgtccagtcttggttatttctttatagcagtgtgaaaatggactaacataagtatgttccctcttagaaagctgaaaactatcatttctatttttaaaatgaggaaattgaagcttagaataattaagagacttcctgcacaagacatggctagaaggttcagctgccaggaccagaagtctgggtcttaggcttctaatttaggtgctaaagcaatggttctcctgggactgaggcattgtggggtgcctcagtggatgtcgggggacatcactaaatattgtaaattttcaaaggaactaaagtaacatattttggatgtacatgaactactaatgctttcaaccttaggttttttaatgttctatttggttgcattatatctttatgaagctgggttttgtaatgataaaaagtggggagcacatgaaaatcattgaaaatcatttaggaataggaaacgaagatagcagtgtcccatcagattccaaagtctaagaagttgtactgtgttcagcacgcagtgaggatttaagtacttatttaactacttaataaattgtttggttcagtgtgctgtgaaaaaatttctgtgagattaagagcattgtaaactgagaaagcatgtcttctctggggacattaccccgctaggattaaagtcctaaagaaattgaaattgctggatgggaaggctgtacaggagggaagaactaacaatttattggattggtcttgcagaattctggccaccttgtgggcaccacctttttttgcttttttatctgagaagtaaacattggctacagtggaaataaaatgacacctagtttagcaatttgaaagccaaggtcatctttacaaagaaaaaactgtggatatcctcatactgcttttaacctgtccttcacatcagggagtgcaaaatctgatagatatcttgctggattatcaaacttcaaaaaccactgcaaaaccagtatggcacatcatccctaacacctgtcagtgcttgttgttacctcagtctttgtcatgtgctcactgagaagcttaaccgtggcaataaggtttccatttctttaattgtcattcaggggttaggttttttctccttccaaaatctaattcttgaaatgatttttatatcttgaacacttcctcctcattgctgtacagacctctaaaatgtgcctttttatgaaaactacacctgacaataaatttaccaagaagcatagacattttaaaagatcaaagaaaatagggattgaaatttgtaagtgatgttatcttaaacaaaaatgggtgaaactgatatcctgtgacattatggagtgctacgatactttttactctaggaactagagaaataaaagtcaaaagatgagggacagaaatctgaaagaaatcagtttcaatattctttaaacagttgccttattgtgagttaggatggaactagagtcagtataatttcaacaaaaaaacctctcactttaagtttataaatatgtacattacaggtgctgtaacttcttaatgtgcaaaagttctcagtcctgaatatgaatcaaatcacttctggaaattaaaaaaatacacacatgccagggacctataccagacttaactgaatcctaggggttaggacttttgaatctatgtgtaaaacacaattgatagacagtcattgaaatcaggagattattgaattagatgttgtctggcttagaactttagaccagcagcattggtattgcttgggggcttgttagaaaggcagaatttcaggaacttccctagacctactgccctagaatctgcagttcaacgagattcccagggattagtgtgaaagttctaggagcactgaactaggagagacaaacacgaaactgggattctgggcatttgtatgccattgctctgtcacttctacaagtcgtatatcctttgtgagtctatttctacaactaaactaacagacataattatacctttccaactgactccaagactgttctaaggatataaaatggaatatggaaaatatgtggaagtacttaaaaagatttaaactgcactgtttatgtaaactgttactctaatgtgggcaatagaaccacaaatgtagagctactttgctcttcaatttattccacctctatattttgagccacatccttgattgctacatagtttgccacccccccacccccaacacacacacacttatttagcctcccactacaagcgcccaaggtagcattacattactgttttctcattactttcaagtcataaggaagtaagaatacaagcaaaaggatagctcaattactatctggaatatgctatatacattaatgtaactctgtatttggaactttgggaatgaaggattttagtaaagccactttgtcattatgaatcccatagtttctctctttgtggtgaattaaagtttgacacatgttttcttgattaatggatgatcttgtcatgagtttctttgtgacagtaaggtgaatttggtactggaactctgtcattcatttcttgggaaataaaaactggaagaacgtaatcattagagcttgcctgggccctgttctcccatcttctttgctccatttcgaccacctgatgctatttgggggttcctggctttttgagccaccctttacccccaggcccttcctttcctaccaacctccttctaccagacccccatcctaactggtggcctagagcttcctcagtacaagcttggattcacctctaattccactcttcactttagatggctaagccagctataaccccaaggttctgttctgcctctgctattttgaaagtatttttctgcatgcatttggcgttctgtaatatctctcagtattctgttgtgctggaggcaaattctaataaagtttaaaaaaaaaacttttgcctcttctcccacataccgccccccccccctttttttttttttttttttttttttttttttttttttgcatttcttccacctgatattgtgggagaaatgcaaaaaaaaaaatgaataatacattcattgctccacatgaccctagcttttccatgctaaagtcttttctttgaattctactgggctcagttaccatcttttgtgctcagattcattgtatttcccttcaatctgatgtctgtctctaatttaaagctgtgtattcctcagccatctgttgctaagggcagaccttaggataataaagtatttgacttcactgttcacatgtttcttactctcatttcctggatggtggggggcactatttaattctgtcaagagacattgtcattctggaggtataatatcttagagtgcaactagaaagtcagccctgaggaaacaaaaccaacccaggctccacatttcctctgatactttcttgtcaaaaaagaggtagcacaaattagtcagtcagtcatccaacacgattttgagaaattgtacaaatgtcttctctttatacctctttgtggtgtctattacatgtatggtacacatatggcatttccagcagaggtttttttgttgttgttgttgttgagatggagtcttgctctgtcgcccaggctgaagtgcagtggcgcaatctcggctcactgcaagctctgcctcccacgttcatgccattctcctgcctcagcctcccaagtaactgggactacaggcgcccgccacaacgcctggctaatttgttgtatttttaatagagacggggtttcaccttcttagccatgatggtctcgatctcctgaccagaggttttatttttatatgagtaaattcagacaatgtatcacacgtcttactatttagctacatagccacaggctaacagcaactagcaatcagattagaattcaaatgataacaacttattatttgtatcatttgaatttaatttgtttgcaaatttcatgagatcgctcctacacattattctgtttttcttagtgtttagagagagtacgaaatccaatcagtaatcatgaggtatccattactttcaatgtcaaaaatcacaattacttttgcattaaactaatattattgaaagatttaagagaaatattaaaataaatgaatcaaaggaaggtggatgtcctaggatctcacatcaatttggtcacttgcatttgggtttcattttaaagtatgagtagtttttgacagaaactctgtgcagtattcccagaaatatttcagtactaagacatgtgtcaactattcatgctctgaaattcttactgtcaattaccttgaagtctgttgtttgcgattatctttttgtcactgtgttttttcctccccctgccagactagattgttttagctcatttcaaggatctctgttatctgatagtcacaccatggtagagtttcctctcatgttgcatagggatcacttgtgtaagctataggatattgtggaagtaatggaatgtaacttctgaaactaggtgatacaagacattgtggcttccttttgcttttttggcttactggattttgggaaagccagctgacatttcgtgaggaaaaccaggaagccctgtggaaaagcctgtgtggcttcctgccagtgaggaactcaggcttcttgagaatagatgtgagaataagctattctggaagcaaatcccccaactccagccaaaccctctgatgactgcagccctggctgacatcttaaatgtcatcccatgaaagaacctgagtcagaacttttcagcaaaaccattcctgaatttctgacccacagaaattataacacaataattgttgttttaagcagccaggctttggaataatttatcatatagcagtaggtaactaatgcatagactcagtatcatcaatatgaagatctctgaactgaatgatagtagacaaatacaagccccatattaaactgctaaagaaattaggattacccatgtctagttgatttatatttttgtatgtcttaaaattactatccattaattttatggttaaatacaatttaagttaaaagtaaaaaatagtataaaatcaaataaagaaggaattataaaatcataaatagattattagaagactttaaataattatagaaataattattctatctctaaataactgcagaaattagcaatctctattcagattgtcaatttttgagatatattaaagaaagtaggataacataactaagtgctatttaccaatactttccagttctgtgtaaagttaactgaacatataaaacatattttctcctgctattgactttttattgtcctgtgcctgtagtaaatgtaaagctgctatgcttaagggtataattttgtgcaggaaaccacaatatggtctggaaataattgccacaaagaccaagatgaaaagataaagttaacaaaaatcatttgacatgcctatcaaatctgttctctgaaagaaacatttcaattatttaatgatgaaatcaatattagaggaaatgctatagatttcattttgtcctatagccaagcaacaattatacctctatatctgttcttactttaggcagaacaaattaaaatagactcttaaatctttctttgagtcaagctatagaaaatttataaatttttagtttttcttggctttacatatttctattatttccatctccccattcacaaaatcaatcactccagatattctcattccatttttctttatgacgttataaaaagtaaaacaaatttgggccaaagagtgtactattattatgggaagatgctgacggtcccctggggtgccacacagaaaccctggaggaggtcttggcatgcttttcctgatcccagctctctctaaattgaggcccatggggtgttcagaggcagcatgcctagcccaagagttcctgtatctttttgcactttatttggaatgcttaggttactgtaaggctttcttcaatgtacctgaaaggggtctatagttttccattttaactcatctgtgcaagagatctttgaggaaatatgccaagtcctttgtttcatctgcatctttacaaaagggtctccctgagccaaagtaggggaatgttctctgtccacatccacactgttgcaaagagtttgctcctcatatcctacaagccctgccttgggatagttcactagagcaccatcaacatttacttggaggatttaatggagagatcccaaaaaagtaagacccaaagatggttctggtggttaattctttgtcaggaacccctcctgaatatagaaaaacatatgaatgtgaaagaaatggggataaaaagtctgatttcacaataaaaacgaggtatcattctttcctcaaatatttattgggcatattactgacagacagctcatgtcatatgcagagaagaaattttaagacttgttttaagtagaaccttaaaccctttaactaatacagacatagatttgccaataagaatgcagaatattaaggcatcttttgtttgtttttttcagaggagccctcagcttttgttgtgaaattgttactagaaagataacatgctatcaacagataaagtcaatgatagggctccaaattattaaaaagtgttaatccccagctctctattcaatatattaatctacataggttcaacatatgaatccatcattatttgaataggacttccattaagtgatgacttggtcaacatcttgacaattcacttttcttgttatgattttgtgcacaaaaaattgttgctgaatagagaaacaatgaacagtaacttcagctggtagaaatccaaagccctgttttccacagacacataaaattagttgagggtagccaatattctaacctgtacagcagtctggatgtgctctgtgggcttctgttactacatcccgtctgcaaaccaggtgcacaaaaccttgcaaggaagtgaagtctggttagtggtaattaatggagttgtttggtgaataaagtcaaagtagtagcaatatattattctgaagagtgtaagaaaagttatcctgaagctaaaacaagaccttgcaaatgaaagcttccaatctcagtcaacaaggatattcttacactcaattaaaattcaatgtctaattatcaacccctgcttaaagaagaggggagggaaaaagatttttatggggtggataaaatgttccctataaagcaaataaggcaaagctacttgtgctgatgaactgtgaaaataatggcccactaaacaacttactgtgcttaagggctaaaattaaggttatgtctcatttccgctctccaaccgtatgtcctctagataagcctggctcatgattggtgccggaatctacactttatgttctcctatatttgaaattattttctgtaaattgaatcataatttgaatcttgtttaaagattaagatgttagtgcttgttaagaaaaaatggaaagaagtattagaaggcattggttacagataaattaattatttatgctgaataattattaataaataatttttctttcataaaatggaaatgtgttaaaaagtaatgagagtttttggagggtttatggattatatattcatataataactctaagcctctttataataatcatgtcaaggacagttgaaggataatgattctatggctacatttggattgagattcaaacaactgtagtcaacaataacttaattggacatttaaaaataactaaaagaatgtaattagattgtttataacacaaaggataaatgcttgaggggatggatacgccattctccatgatgtgataatttcgtattgcttgcctgtatcaaaatatttcatgtaccccataaatatatatacctactatgtacctacagaaactaaaaattaaaaaaatttaaaaacaaattcctaaacaggaagtgaaacaaaaacaaaaaaatacaagaataaaaagaagaaaaaacctccaactttcttacaaattggaaaactgtcactcttatatattaaatatttagacaaatttcctgctgttttggataggaatcactttctcagttaacaagtgcgtatcagtacatactagatctttaacactggcccagactgagatactatgatttgtaacagaaatatctgggcagtttgtaaatgcagatggctgggctaaggcaccagaacctgttattagcccaatttgagcctattattctgggggagttataaggaagtgaaacacctaagtgagacactttagtctttccatagggtgtagagtcggataggagaaattactgtataatttagaaggctagatctttacacagatacaacagcgggtaattgacaatttgtaattcacctttgactataaatggtacctcctaatttttccccattggaacagtaaactgatgattaaaatttattcagtcagtaagaggtgatatattacttgcctagaccagtgatgcttgatattttcttgatgttagtcccctttcgaatctgatgcagatttgaaacttttacaaaaaaaaccttttaattattgtattttttaatcaaaaagaaaaaattaagaatcaactacatacattcaaattatggcacatatactgtatatatatacatgtatatgtatattgtgtgtgtaagtgtattatatatataacaaaagtagtaaaaacttctacttttaaacaaagaagaagaccagttatttggtttcactgatgggtgaatttacatttattcaaaaatgtaaatgaaaatttccatgggaagtgtttagaacacaaacagaaatggaataagatgaatactggaagacataaacaattacagagaaaagaaaaagacaagtccatgaagtagaataacaagcaatagccagagagaaagaaaagataccagagagtattatgacagtgatgggagagtttatcatcaaggactagctgagcattagcagaaagtgttattaaagtcagttaagataaagaggtcaaccatgaggttgtctgagaagtaaagtttctaggacttgaggacgtcaaagatctatatgaatagagcttaagttgtttttatggattttgaagtcctctgacataatagcagggcttgatgtgaaaatggtgactgatctaggacttcttcatcccatgtgagttagattctgggaagtggtgaaagatagcaataagtaaaaaggcagattcatcctgacatgcaggttcaagccaaaattgatgacagacaccaaacaacagatcaaggaagctcacagaacaccaagaaggataaataccaaaaaatctacatgtaagtatattctattcaaactgcagaaaaccaaagacaaagagaatgtcttgaaagaagccagagggaataaaacaccttacctataagtaacaggataaaaattatgcaaacttctctatagaaagcatgccagcaagaagaccgtagaatcaaatatataaagtgttgaaagaaaaactcattaacctagaattctatatcccatgaaatgatctttcagtagtgaaggagaaataaaaatttcttaggcatttcaaattgacagcagagtttgagaaccactggtttagggaaaggtggcttatattgcaagaatgtatgcaattattctcataagtaactttggtcagaaaattttaacttaaatttgtccacagctcttcctcttccactgaccactaaaaagaattttggctttgtgagctgtttctctccctcttagttttttggagtatcttacctaacacaaaaatcaataaaagattgggtagagaaaaagattaaccctgacttagaaaaacattttattttttctcttgtatgtgtgtattttgagagatagcaacataatagcaatatatgaactaaatgaggaaaacttacaagctagaaagggagttttcaaataagtgttgtagagtttatttctttaatggtgtttgaatgatataagtacataggttgtgttaccttttacttattgctctgtgttctgtctctggtgtaacactggatgagtgggttatgagttgaataagtttatcgtaaagatatattccacaagtatctgataaggttttccctaagcttgttgaaatcaccatatgtgtattaagatttccattaccatatagttgatagggatagaaattttgttttgagtgtgaattgccacatgttcagggaggcttctacttgttttggcaagacatggcacaaacatctcacgggaaaggctgtctcataccacttgatatatgatttgcagcatattcattactaggataatttgaccacagagatatcaataggttacttattttcagaaaaattggacaattaaaaaaattatttcacaaaagggaatatattattgtcattttaatgaaattcagttgttgcacaagtttgtctgaaaactaaaaatgtgccttgagcttcctggggtcaaaaataaaataatgttagatattaatcaagcgttatttcttccccttaccttctatccatttttctttgattttattttctccaagtgaggatatagcagatagattctaggattatgaaaggcattggacttatgtaccttaagagtttgaaactgttttttgtttgtttgtttgtttgttttgtctgtttgtttgttttgctgcttcttttgggagatgagttggggagatgaaaagactgaattcatgctctgttataaaactttcactttgactgttactttttaactaaaacaagccatgaacaggctactaacctagagataggccaagcgatttggatctcttagcaggagtggtgcaggtctagagtaaacactactgtgttcattgatctcttaatacagatggaacttctttatcccagcaatcaaagactccatccagtgtaaagggttggaggaaactgggaaatttgggcatttgcttattccttctgcatagaattaaattatgtattatgacaacaactaagcatattaaaaggacacacacagatacataatataaacacacatatataaaccatatatatacatatataaccttatttaattaaaaaaacctgctaaattgtataatacatctgggtcaatggatatacctgccaaacaggtaagttacattgtataataataaaatgcttaggtatgaaacccaagtctctgaagcctcatgtgctcctctttcatcctaataccttgctctccctacatccactatccttaatgttgtttatcattagcttgctattaaaaatagtttttctactatgtattaattcttaaacaatcgagctttataaaaatgctgtcatgttatatatagctttctgggtcttgtttattttaccagtatgtgttatatgtatctgtaacttatccatgtttttgcatttcctgttgatgctgaagaacatttcagtttccattgttttgcagttataaataatgttgctgctctgaatacttttatacatgttttctgttgtacatttcttctggtgcacatatgttaaaatttctctgggagtttaattgctgtgttttaaggcataaacatgtttaactttataagatagtgcctaattatttttaaaatggttacaaaaattcactttcccaaaaataatgtatatgggttcctgttgatagatattaccctctaatattagcactatcaaacttcttaatttttgctaaagtagttggaaaacacacattcttcagaatgtagaagagagggaaacactgcttgattcattttatgaagtcagaattattcttttgatgaaaccaaagacattacaagaaaggaaaacaataagctgatatttgtcatgaatacaagtgtggaagtcctcaacaaaatgtcatcaaattaaattcagcaacatttaaatatattatgatgccaaaattgagtggatttactccaagaaggaaaggctggttccacattcaaaatcaatttggtcattcagaaagccaataaacaagaaaagccaaatgattgtatttatacggaagaagcatttgacaaaattcaaaaaccactcatgattaaaacagctgacaaactagcaataaaagagaattttctcaacccaataaaaggatctgcaaaaaaagacactaacataatacttaagttatgtgaaagactcaattctttccatttaagatttggaaagagaaaaatgcactttctcacaaccactcctatttaacatcatactggggatcctaaccaatgcaataaggcaagtaaattaatagttatataaataaatgctataaatattggagagaaaggaataaaactctgttcaatgatgacatttctcattgtctctgaggtatctacaaaaaagataagaattaaaaagtgagtttagcaagatcacagaatacaaggtcaaaatataaaaattaatcatattggtatatactacttaagaataatttaaaattgaactgaaaacctgaaaaggagtataactcatggctagctactcattaattcaattaacaagtttttcctgtgcagtttgtgattaaaacacttagtcaggacttgacttggattttcagatcacttcaaataaaataatttgtttattgggttagacttctcatgggtcaacgttctcctagtctcattctaagtatttgatgatgcaatcacaactcagcagttgttatatttaatacagattgacaagagcctttatttccaaaaattggtctgaaataactgtgatcaagttaaaataatctgataaataaaacagaaaatgcatctgatctgcatcatggcatctcatcactcaagagcatatgcttaataagttacaaaaagaagagagaaaaagaaagatgtcctgaatagggtggtcaaagatgacagttaaaaagacctccagatctctttggaatccaacatatcactatagatttcataaaacaataattgtctttctgaattgcttacacggtaaacgaattattaaataataacttgaaagtgaagcacagatgtgatctggctgtggttcacctattgtttacttttaatggaaatgttttttcttcaaatcactgacttgaaacatggtggatttctatctgtaatatagacttctttcagtctatgttttacaagttacattatacactatgccatttccacattcatagactaccaaagtgcttcttccaagttgccttgatgatagatgtaccttatatgtgtcttcactaaagctataaagcattgaaatcttttctcaaggccttcaaaagaggaagtaattattttcaagcctccacgatgtcctaagtaaaaacatctggtatttctgcactcactattacagtaaaaaggaagccacactagaagctacccaatttctgggtacatagttacttagagactgttatatattccataatgacataattttggtttttttcccttatggatttttctatatacattactttgtttatttgctcatttgttcctcaaatatttgagaacttagtatgtgtcaggcagtgaaccaagttacatgagtaattgtgtaggaaacaaagtgaaaaagattatacggaattactccctaagaactaatcaatccagaataagcaagatctttaaatctataggtagtaaaatactcagattagttctgtataacaatctgtataacaattagttctgtttaacaattatatacagtaatgttacttttccattctgctctctagaacagaaatgataaaaaagatagttgtcatggggcctaagactatcactattttatggcttgaatatcatggccaattttatttattacttgtttgtttcagagaagaatgccagagtaaatgtattagacattaaaaatatgttgtgagaaaggtagaggtctatctagactcttgttgctctgtcagaataactcaacaatatacttgagttggaagaaaaagaggttgcccctgaaggcttgtattggattgttgctttatcctgtggatgggtagcatcagttcagagacggaaaaagaaaggattcagcaagtgaagtctaagaagcttatgtcagaaatgcttggtattcgtgtccttgaattctgtatacccaaaggaaaaacaaggtaaaaaagcatggaaaatttttttaggcagtttttgtagttcaaaaccagcttgtttgctttggtggctaactctttttaagcaaaaatcccagtttttccagccacagtacccacatcattcttcagaggagtatactctctgtaatatattaataaccaggagtgaatagttgccacaaatgtggagaagagaagaaataaaacttaaaacaaacatatttcttttgtatgaatgatgccatcggaaaaagaattttattaaaagtagaggcaagacttagtacacataaatggcatctattagtttgtacaaggttgttttgaactcacaatttaagtctgacattctagttagcagagtgcattattagaagtctgcaatctggtgatctcaatttagataaagccaataagaatatatgaaaattcttaataggatttttagatgaatttaagtatttgcaccatcctagtagataagaaggaaaaacatcactttggtaatagttcttcaaaccaaaggctcttgtgtggccagacaggatatatttaaactccaagaagtatcgtaatatctatggaaacatatttctgttgaggtaattgtacctccagtaaaagactatttgaatcagcttgagttctgccctagctctctaagaacacaatacacattctgcatttgttaagtacagaatatgaggtcacatatcaaatagtaaggattcattgaccatgagaagaaattttaggacattaaaaacttcttaccaaagagtatctaagttcaggtaattatgcatttctttttacttcatttcaggaggtaagccagactataagaagaggagaaatggcaaagagaccgaagaagaggcattgcaatatggtgtaatcatataatagaatttgggtgagaagtacaatttgtggtaatatatagtcagcacaatgaagagtggattccagaaatacaagttcttgctttaggaagcagttctgcctatgtcaatacagaattctcagacgtaaagttggcgattatgtagcttgcaagattatgaaaagcagtagcatattgcttgcttctaagcttgaaacacagtaggtctctaataatatctggcttccccttcttactacataaagcatttattgttcagtatggcaattatattttaagcatgctgcattatgaggtcattgaggaatgaaccatttctcatttacatttataacttcaatatcacatatctggtgattatagagcttaaaaatatcaaatggaagtagcagaattgttgtatagaaagaccatgaagggaaatatctcaaaaataaaatattagaagtattctaagcattattggtagtattacaatggtagtaatgttggcagaaaaagagtcagaaatggttttaaaatgtgttgaaggatttgaaagccaatgaagtacggttcaggagagttgtttatcaagcactaaaaatgttcattgcttctcagcaattctgtaagtatcaataatgtacttgactattcgaatcccaattgctccaagaagtctttccaagctcactggatcaaattaactctccctctttggcttgctgccacattcacagtccaggatatggtcagcgactgttcagtagcaacagagtttgttgctattgttgctactgtgttccacccactgtcctaagccctgaagatggagctgaataagacagtctgtcaaggatcctgctgctatggagcttacatccttgctgggttactaacattagactgaaacctgattcacacttagttccttatttcaactgtataaatcttgtctctgttttttgaattcccaacaaaacaaatagttccatgaaaacagaaaattgtcatatccttcttccacagcatgaaccctttttaggaataaatgtctaaaaaacaagcaaaataaacaaaaagccgagcagctggaaagagacagtaagttctcaatttgctgctatcagtctcgccattctaccttggtgtcaattggatagattgaggttaggagatagagatgggttacttaggcatatttctaaataggaatggttgaagaaactttgaagagagaagtggttaataatcaaaagaaaatactttgtgtatcatgtccacagtgggtactcaattgacatattttccaaaatagtgggttgtcttaattatttgtcatactttttaccatgtatcacaatgttagagaagttacaaaaattttttttaaattctgagttgtcaatgaaattgatccagtgaaattccaaaacctacatgttcctaattattctacaagctattgagatgcagctgaattctttttatccccttggatccactgggcatagttatgatgtgacgtagctgagagattttcaaattcattttacagggtactcatctgtggtatgagtattatccagtacaaaaacaaaaacacaaaattatttaactataaaagctattcaacaacttgaaacaaaaaaaatcatagaattccccttttctcgtttaggaaaaaaaaaaagtgcagctcactgaaagcactcatttaattttacataaacatgctctttaaggctaaagcaaatatgactgatattcaatgcgaaaatacaatataaaaactgttcttggagttatttctaaacagaactaacatcagaattgtctgtttgggaaaaatcagattcctcaaatgaatcttcagtcaacacctgttcaagagtgatgatgtttaacatgcataagaatgctgtgttttttaggatttgacattttcagcaatctagagttactatattttgtaaatggaaataccactactaaaaatagaatgttaaatagaataatgtcttttgtttccaaatttggcatactagagcaatgcgaaagtcataataaaagtgagatatttcatggcaaatttaacttggggtagaagctgcaactgcaagtgctgctggggagtattcttggaacaaacaggaagggagttaatgaaatagaaaaatgatagcagaataaaatcttttttttgtttgttttttgtttttgagacagagtctcgaactctcgcccaggctggagtgcagtggctccatcttggctcactgcaagctctgcctcccaggttcacgccattctcctgcctcaccctcccgagtagctgggactgcaggagcccgccaccacgcctggctaattttttgtaagcaaaatgaaatcttaaaactccaagaaataattacaaagtaattaaattactcaaaaaaattatattatcatttaacatggagaaattaggttttgctcaagcagtagtatctataagcagtaatttacacacacacaaaaggtcaaatgaagtgacagaacacttttactaacaaaatgtattgacataattaagatgaaaaattatggaaaagattgttccttcctcaatatctatctctgtgtttccaaacataaaataaaatcagtgaataattccacatctagctttaattggtagtgcctaataatttaaggtgaaacacaaagcatcaagaaaaatttttaaatggaatctattaaagtatgctaaaattagactaaaagttttacttcactagattaaacccaaggaagatatcaaatgggtttaaattgtgaaagcgaatatgaggatggtaaacaaatcatcagtgcaataaagcagcacctcacgttaagaacgctgggcaaggcaaagttatatttctcatctccgtttccttttaactgttctttatggtgaactaatacaatgtgttttgaaaatacctgagttacctattatggaagaaacttagggtgagggtgaaccttggtatttgtgaaacagagttgaagccctagttgcaacttcttacatggaatagctagtgtcttagagggcgcagtcattcttgaagtgatggtaaacatcttgtcctaaattaggcagatgatgaacatactaagaggttttccagccttctatatggtgtaggtgaagaatttgaaggttgagagcaaaaggatgagagtaagacatatttctgtctccagtgtgaagaactgatctttctattatgcctagaaatgtgctcagagagtaaagttgaaaataatatataaatatgagcaacttcaaaacatcattatattgaacattaaaatttatagatactatgcataaacatttctaaaacatggaaacagtacgatttcaaaggtaagttaagggaaaccaaaacaaatagagaggttctaagaaacactctcacactcttgggttttatgaaggggaagggctaatttcccaagaaaacctctttgatctcagaagagaagtttcatttgcttgtaaagaatgacatgctcatacttggattagtaaaaatatttaatttggtgccagcataattctattgaacccttaatagaagctattttttcaaaatttttaatgttttgtgttttatcctaaattattaagtactactattaaagctagatgtttgaattatctattgattttatttcatatttagaaatataggccgggcgcagtggctcacgcctataatcccagcactttgggagtccgaggctggcggatcatgaggtcagcagatcgagaccatcctggctaacatggtgaaaccccatctctactaaaaaaatacaaaaaattagctgggcgtggtggcgggcgcttgtagttccagctactcaggaggctgaggcaggagaatggggtgaacctgggaggcggagcttgcagtgggccaagatcgagccactgcactctagcctgggagagagagagagactccatctcaaaaaaaaaaaaaaaaaaaaaaaaaaagaaaagaaaaagaaatatagagataggtattgaggaaaaaacaatcccttttataatttttcatctgacttatgtcaatgcatattgttagaaaaagtgtgttacttcatctttagtgtgagtgtaaattactcatcataaatgctgttgcttgagcaaaacctaatctctgcctgttaaagaatattacaattctttctttttggagtaatttaattactttgtaattatttcttattttatttattttctgtaaattaacatttactatcctcattgaaataatgagactaaacatatttctttttttaaatttaaattatgtgtatttagtatggtaggaaaccccaagtatgactaattttaacagtgaatatatattcatgaaattaggcatcctaaaaatataaaatttgtagcagcaaatatataactgttcccaaatattaatgacgtaaagaataaccaaagattctgagaactacacagtaatttggttttaaaataggtctttaataagaaaaatatccattggccttttggactctgtggataatagtaaacatatgaagattatttgagaaatataaaggcaaaataatagttttctacatgatttttatctgttcaaagaaaaatgaggaaaaagtgataaaataaaatatgattgaaaaagggaaggaaaaagtaattgcaacgatctactacagtggtttagcgtcaatattgaagtaataattttttgatatgtagaatctaaggaaatcataggctcaaaatctggaagatatattggggtagaggaattaataagagaaagagttgcacatttaaagacctggaggcaacaaaggtcatggcacattcagaaacctgaaataaattcagtatggctggacttatgtttgattcaacaaaacactaggggcatttctctagtgggtattgagcaggtgatcacaatgaatctgtggtcatgatttgtgaatattcatgtgctctttaactacatatatgctaaataatgttagtaaatcaattcttaaattgcctattgaacagtttacaaaatttaagagcaagctaattctatcttagcattactgtaactggaagcaaacattcttacatatccagagcaaatgataagaaagatagcagtttaataagaaacataccaatctactttatttttactgaatcaattacagccttaaaatgtaatatacaccaacattttccaaataagcatggttctcaaaattctttgcactctaagattggtaggattttgttataacactattcatgattcaacagaattcatataatactgtttgatagttcatttattaattcagaaaatagttatgaaaacataccttgtgccacaaatgacccataagcatatgaaatgctcatctttattaatactcatggaaataaaagttaaaacatcaagacaggttgatgaatagatactaatatacagctaatataaagaagaaataagacctagtgtttcatagatcagtagggtgactatagttaacaataatctattgtaactttcaaaaaaagctaaaagaaagtaattcaaatattcttagcataaagaaaaaaataaatatttaaagtaataattatcccagttaccctgatttgatctttatgcattatattaatcaaattatcacatgtatcccaaaataatatatacatcatatttcaattttaaaaacctgggaagaaaatactatcaattgtaaagcaaaatagttaaagtaaaaacgagttatcttttcacatcattatgttactaaaaatatttttttaaagttctgaaaatacattgttggtgaagatgtgttctaataagaacaccatgggagtataactattaccactatgaaaactcattttatatcatcttgtaaagtagtaaatgcatacacccccaacaattctactcctaaatgtgtgggtactagatgttttcacaatagtgaaaatgaaaaaataaaaataaaaataagcaagcaaacaaaatttagatcccttaattgtagaatgaataagtaattaatatttttataaaaacatgcaacaatggaaatgaattaacgacagccaaacttaccaatatggatgagcctcaaatccaatcttggggaaaaagtcatagaaaatacatgtagtctgattcctttgtacataaaggtcaaaagcaagttgaacttgcttttgctcttgcttttgaagctgtaagttgtctagtgatgcatccgtataactattatgaaaaataagttgttgataatcacaacattcccttttgttattatcctgtcctgtcttcctttgatagcactatttattctgctttttgcttctcctgtcctctacttcatctaatattcacctgtttcaatcttaccatttttttttttttttttagacggagtcttgctctgttgccaggctggagtgcagtggcacaatattggctcactgcagcctccgcctcccggattcaagcaattctcctacctcagcctcctgagtagctgggactacaggcgcgcgctgccacaaccggctaatcttaccatttttaatatacaaatttgaatgtcttttcctctgtgatttgttttcttttgtaatgcaaatttatcatattacttatcacattatatctttacaagattacttgtttgtggttaattttatattgcaaccacctcagagacagagattacaggtctttatttttacaatcttagagcctttagcaaagtgtccagcatatactacaaacacatacatgtttctttgaattgtatttcgacttaaagtcagtttgttgtaaaaacctttagcaagcctcataatgaggtcttagcgtggaggaacactttgctggatatttttaaggtttaaataaaatgtaaagtgagaaattgttttagaggcaaagctatgaaagtaaatataatgaaaatggaattaggaaaaaggattcactgtatggatgtatgtgtgcataagtaataaatgtgcatcactttcaacatataatcatgtaacaatagaaacgtttccaaacactttattgtcaaattatactcaccaaaaaattagtatatacattttaaaagctttactttcaagcttattgataaaactttactatgaagaaatagtgttatttcttcaaatactgttgtaaaattatttttgttgtttttaaccttgtagtacagccaagagcttgttccaggagtaaaagtgccagttctacaactttttggttattttcttttgcttctattagtaatgttatttttattatggctatttatagaaatcttttaaagccatcttgttaggattagtttaattaaaaataaataatataacttataagtctacttaattggccatatgtaaactccaccatatgctaatatgctaaaagcaaagaaatctggagggagtcaccctcctcttccctcacggtgcctcacctactatgatttctctcgaccatcagacaaaaggtggtgtgtttattagatattaggaaaacttagtttctgtcttgcgttttcgttaaaatatataacaaaatttttcttgtgtcacacaaattatgtggctttgcacaccccacatttgagcgcttatgaattaatctcataactttcaatggagggtggggagatgtatgatcaacaagaaattttttcaaaattgtcacattcagattattgcctcttcactaccccagttaaggaccatcatattaggttatagtggtcttttactctaatataaagaaaaagaaaattccaattgaatgagcataagtttgaagatagatgagtggccagtttaatactatcaaacaacagtagttccccaaacaggattttttaaatgtgtttttttcaactccatctctccttcccccacttcttaattcatagagttaaaaaagaaatgtcataaaattatgtataggctataatcccaacacatgggaaaaaatgtcaagtgagaagagatgggaggaaaacaccaggaaaataaaagctatagatcatagaactatgaatttcatttttatgaacttcggattattattgttttttttctctctttttttattattatactttaagttttagggtacatgtgcataatgtgcaggttagttacatatgtatacatgtgccatgctggtgtgctgcacccattaactcgtcatttagcattaggtatatctcctaatgctatccctcccctctcccccccaccccacaacagtccccagagtgtgatgttccccttcctgtgtccatgtgttctcattgttcagttcccacctatgagtgagaatatgcggtgtttggttttttgtccttgcgatagtttactgagaatgatgatttccaatttcatccatgtccctacaaaggacatgaactcctcatttcttatggctgcatagtagtccatggtgtatatgtgccacattttcttaatccagtctatcattgttggacatttgggttggttccaagtctttgctattgtgaatagtgccgcaaaaaacatacgtgtgcatgtgtctttatagcagcatgatttatagtcctttggttatatacccagtaatgggattgctgggttaagggcagccagagagaaaggtcgggttacccacaaagggaagcccatcagactaacagcggatctctcggcagaaactctacaagccagaagagagtgggggccaatattcaacactgttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaactggtaccagccgctgcaaaatcatgccaaaatgtattattgttaatttaaaaaattggaaaaccacagtgtctgaaattaatcatgagtttatgcttaaatccctgtaggaaacagaaaaattcataagaaacttccataaaaatcaatttcatcaaattttatattaaaacagaagagtaaatatacacatgcaggtgtatacaacacaccagtggatgagaaagcagtttctggggctttctggaagagtggcacatttgaagccaggctgcccaagatatattctttctgtcacttaatttctcaggacctctgtttcattgtctctaaaacgagtgagttgaactagttaatctctaacccttccaatgctaacattatataaggtgtatgtgtctggaaaatttgcagggcaaatcaattttttatttgaaacaaatatcagaaggaaaccttctagatttttcttcttcaagtgcaattggtttcacacttattgaacattttccataggccagaaactgataggaactttacatgtatcgtttcaaatttttataaaaaccttcagggatgaattataatctctattttatcataagtaaattgaccatcaatgcaactaacaaatgactgagccaagatttgaatgtaggtatgtctgaccccagtgtttctattctctctaccacagtgagattgtttattgaaataaattatgaaaaaatgtattattttaccttggaggtgagggcaataattaaaagatatgaggactaataatgattttcattattgttggttatactcttatattactggaaggaatggaggacagccctttttctcaaactcagcaacaaagtttggtttggtttataaaatattttctacatgtgtttattttttattttcctgaatgtttgaaaactatcatgtgcgtagatgcaccatcatgtatatttattcttgaatctgaaattccatctaggtggcaacaagtctgttgcatattttatgctcaattaaaaagaagtcttacaagatttttatgtattacggaaagatcaccatctgtcccctatttaattaggtccatcctgattatgttacatgtgttctggctccctttaagaaaattttctacatatacatgaaggagaggcttgctaaaaatgaattgtcagcaagaaacaggagagatttaaacaaagaaactccaagaaaaccttaacaaagagaaatatctcaaacctgaatccttagattcagtaaaataataacccttccccttcacctctcatgacttctataccaaaatacaaatgcaacttgaatcctatcattttagaagcttcaagagttaatttttctttcctgttacttttcagtttggaacacctttatgctttcggaacaattttagccgggaggggaaatgccaaaatactatagagaaggctctttcttgggtaatttagactagatttgaggaagcaaaatgttgctataaattttatgtttaaaaaataactctgcccatgaaatttccagtgggtttaacagatgcaagaatttcagataacaataaaaaatcagattatcatgcaaaagtaaggaattgttagaggcttcaaggggataaaggataacgtattgagctctgggttctgagacttgggttctctcctttgctttgccattaattctctgatgtttcaaacatttaccagaattttcctaccttaaaaatatgtagcaacaaaatctccccctgcccagtcactagaaatatataagcattgtaaggatgtgaaaattccctttttcattcatttactgtttgccaactacacttcaggaatctaagttctggagatataacaataaataaaaagtatctactcttatgtatcttaaattccaggagtaaataaacaaataaacatatagtatgttagaatttattaagtgacatgcagagaaatgaatccatgtaagaaatatgtaagaaatattttcatagaatgtttacgaaaagcttttctgaaaagtgtcactgaagcaggtacctgatgagtgaatgagccatacagatatcctggggaagagctccctaaagtaggatcagcatgtacgaaagtcctgaggtgccctgcacatgtggattttggaagcactcagccagtgtactggaaaggagtgagcatgataaagtgaatgggaaaagacctattcagagtattagcaagaaacaaacacaattcctaagtctagagtacgtgtttatctgtgaaagaaatggtaaacagtaaattcattaaaaacttgctattctaccacaacataggagcatagctgaaagggctttgatactttagagttgcagaatttactccacaccaaattggtcaaggcaattgttaggaatgtaattaaaaaggagggaacatgaccaggcaactggcaaaaattttccgtaattacactatgcattttgaataattcaatcataattccaaaatgacgcttcttattcctcttctctttctttttcaagccttgtattgcctccctttcctttccattttcttttcctacctttccttcctaaccctcctcttccttttctttgcgtccccttgcttcccctccgaaaaggtagcatactgtatgatttcatttatataacaatcttgtcatgacaaaattatagaaaaggagaacagattactggttgcaggtgttaaggagagggagggagtcagcaagaaacaagtgctataaaagggcaaagtggaggattctatagcaatgaaaatgttcccctacctttattaattttaataccctgtttctgatgtcgtactgtagtttttcaagatgttaccactggggagaattagataaattctttattatttctcttgtgaatctacaaatatcttggaataatagtttaattttaaataatgagcatcatgatactagaagacattttgagtcaattgaactccctcactcacaacatacttcccctatcatcttctgctaatgctgccttggccccaaatattttctgatatgtttatccctagtgtagtaaacgatcattaccaataatttaaattcatctactctcctaagcaagcaagctgtgaactgtgatggatgagctttatatattgaggcttatgagtacagccagttgagaacagaaaaaacacttggatgaacaaagacgtttttaaaggaacacaataagctgatctaaagctcatataggatagaaaagggtcaggaaacatttggaacattttgatgaagaagaagaaattaagttgactgccctcctccttgccactttctatcaagacaatggtggtgcatgaatttttccatttcaacaaatcttctccaatacttgatgttattagaatttctattttttctaaactgatgagtatgaagtggtgtcttgtgttgttttattttctaggaatttgtaggacttcttggtatattctgaatactagtatttctcaataaaatatgctgcaaatataatttcccattctaaaatgtatatgagttcctgtactatatggttttgtctttcttagaaaatgttttgctaaaacttaactgcagccattaaaacctttagtcactcaaaactgtgtgtgcacagcagtagaaatagacaaaagttttaataggagaggttaaagtttcaaaaagtagacccacatatatatatatattggaatctggtttacaagtaaaatggctgtatgtcctagcttgctggtgatacttcccacttatgcctgctgtccaaccataataattaataatgtccccattcaatttcaaaagcttttcagtatatatggtcattcttttttttttttttttgtagagagagtcttgctctgtcaccaggctggagtgcagtggtgcgatctcagctcactacaacctctgcctcccaggatcaagcgattcccctgcctcagcctcccaagtacctgggactacaagtgcgtgccaccacgccaaactaattttttgtattttactagagacgggattttaccatgttggcaaggatggtctcgatctcctgaccttgtgatccaccctccttggcttcctgggattacaggcatgagccactgctcccagccatatggtcattctatatatgacaggagtagactttaacataaataagggtaccattggctatccttatcaaaaagaataaaactttatccatagcttaacctgtaacaaaaataaattggacatgaattgaaaatataaatgtgaaaatatatattcaaactttcagaaataattatgagaaaacatttacaactttaagttggggaagaatatttttaatgataggaaaacacaaaccatgttaaaatttaacatttaaatcttcccttttggagagcaacgtgacaacctgtgtacaagctcaaagatactcaaacccttgggtccaccttttgttacacactgaagaggttttttgcccttgtacataaagggacttgtagaagacaatttactgcatcaatgtttataagtatttagaaatgacctatgtatcagtttgaagaaagataaatacattatggtagctcaaaaaatggaatgcattgcatcagttaaaacaaaagaacaaaataaaaatttttacaaaatcacagggaggcagatcttgacccttttctctccaaattgactgggtcacctgtttgctgtgttctgcatacagggagtgctgaaggcaactgtacatttcatcaaatactatttctgtaaaagtggggaaaaacgggacagtagatattttttatagcttaagatttcttagcaaatagaatttttttaaaagcttgtctatagaatattgtgtgttagccaccaagtgatgtcttagatgtaatgaaaagtgtgatcttagaaaaaagttcaaggatacattttaaaacttaaaacacttcaaaaattgctatcctatcctatattaaactcataaatatctcatattagttcatacgaaactttggagctcccagaaaaaaaaaacacatggaaccagaatttaaatatatattgttttcacttttcttgggtcaatctgttatttacatatgattacctctaacacttgtattaatctaagattatttttactttaaaaggctttttaatttttatctatatttctgacttttgactgttgaaatgttttctctaatccattaaactaatatttgcccttgcctcatggaggtttggttatctccattgggcttgaagagtatttctgatttttcatcttttgtttcactactgaccatcagtttagcatggtgttaaaactgaatatcaagaagcaatagatatatcagtcctgaaaaagtaatctgctctctgagattggcaatttggcattgacgatgaggaaccccaccatgaactaaggctctgatctgtgtcataaatagtattgaaggtgcggggtggtggcggtcagttttaattttgcttcatcatctttaagctgaaaatccctcatatttctcatttctcttataaaaagcctcgtcagacgtctcagagatgacaaagtagttattgtgagtgtttggggcgggaacgatgacaaggaggtttcagtagaataatcaaaaacctatttttctctactttgcatcttgattagaagttggattgtgttgttgataatatgaattgccctatttggggactattaaagtatactttaaaaatatatttcacaaaataactgtactttgcattttattctgtgtttcttcagagacatccagggtgtgctcatcagaacataaactggcaaataccaacatgcttaatgacaatgtggcatgccatttgccttgtgagaagtgctgtatttcatttctttgactggctttggctgtttggtaattgtcagggaaacatctggttactgtcacatactttagcatccgatcttattgcatgacattttgttctgtgatatttggttcccacttgggactaggaattggaaacctcaaattaagttccatttccaacataataatagggaattgtcctgaataatgatgttcgaggttcccagtaatggaatttcaacacagcactttggaaacattggaaaaaaaatagcaaattgttatcagtaattttctttacaaaaatacaaatacataattaggcctcaaactgtttgaagaggctactctggaacttttcttagttttgaaaatattactctttagtttttggactcaagacaaattctgatgaactctcttacggtgaagtcatatacctacatacctttcattttccctttcaataactttttattttgtgtaaaaaaaatttagaaatgttccttttggaatttctgggtatatttctgtaacctttaggttttctgcaccataatttgtatgttcataggttctcttcactggttctccaataaaataaagtaggaagaacttaggtaattaccattttgcctctgcctgaacttggcacatagctcagtgctcatgagactgtaattcatattctggaaccagattggtaaatgcactcttaccattcaatactgttgcatctctccaaactagtcctaaaacttgctgctttcctcatctatttgctcctagaaagtgttgtgtgatttcaggtttctctaggagacttattaagctcacatgctattaagctaaaactgaagcaatcatcattcagagaaagggataagctatgtgttagttttctcaaataactcctttcctaaaacaaaatgcacaaatagaatatcttagaactaattctagaggaagtcgattttgtggagattttcacataggaaatttattggggagtgctcctgggagtctctgagagggagcgaagaaataggattgagaaaaggaaagagctgatataagactaagacacaataaatgtctcagctgattgctcaggggatgaccctatagaatcatccgcaattgagcaaggaggcatgatttatgagccttcactggatgtcactgccctgcgggggccacacaacttgcttttagctgttggggaataatgccttgtgtctaggatccaggcagtcctccagccatgtaccacccaggattctaaaatctgaattgttttcttagaaatagagatgataggtgtgtttgtcctcatttcccaatttatttatgcaaggattaagaatttaacagaacaggtggttatacagaatagaatattcaagatagatttgtccattttcttatgccccctattccctgtgggttaaagaattgtcactttcactttcaataaaagtgatgatttgtattggttggggtaaaaaactaaattattgttaaaccattgttttactaagacatgtaacttttctagaagccctcacggtagtagggctgacccttcctttcaaaagaacattatgaaatatcagtttctcttggtctttaaaccaatcatctaacagacattgtcacctccttaccacctcctgtggtaagaaagccctgtccatgctttggttcttttcacattatcttcgcctcttgtattctgatgcttgagaaagcccatcttcccaagagcaaaaattgtggttcaggaacaaactactacctcatgagctggccccatgcccaggaatccacagtgctgagagaggcatgactttaatataaaatgatgatctagtcaatagtcagaaaaagattttctggaaaagaaagaaatactacacaaatcaaacttgaaatctgtgtaacgaagtaatcacttgagcacatgtggagagtttgagggtgacccagtcattactttagcacataaggaaacttttaataaatgttcacaattgaccagaaaggggaggaaaccaacacgtgctgagcacttaattctggccaggcattatagaaaacagtgaacaaatacgataacattcaatgctaatgactgtcccaagtgttaggaatgattatccaagatttttgttcattctttttttaccttcaatgaggtaacttttctaagtttacttctagaaattggcagagttgggattaaaagttatgtttctctgattgaaaagtacatgctattcctcccaaaaagtatccacaatgtgagatgtgtcattaaagtgaaaaactttcattattcttagaattgcatttctgaaaaattgaacattgggctataaagaatatcattctgatttgttttattttttggaaagtacacatataatgggaagaagagtgattttagtcaggataccagcttcattatctagcagtaagctctgggaagtaaaatgaacttcaattttctcacttataagattaagatattaaagtagaaggataggctgggctcggtggctcatgcctgtaatcccagcactttgggaggccgaggcagacagattacaaggtcaggagttcgagatcagcctggccaacatagtgaaaccctgtctctactaaaaatacaaaaattacccaggcatggtggcacacgccggtaatcccagctactcgggagtctgaggcaggagaattgcttgaaacctaggaagaggaggttgcagtgagctgagctgtcccactgcactccagccttggagacagagcaaaactcagtctcaaaacaataaataaataaaataaaataaaataaaataaaataaaataaaataaaataaaataaaataaaataaataaaatagaaggatagagataaacatttcaagtaatgtgctgcatttgatatagcacccaaattttaaacaagttttctggtaataggactgtgttgtgtcttaaagtctatttatggtattttgaatgttgagtgcttctataatcacctagcattgggttatcccaccataattgtatttcctttacagaggtctattttgttgtaggtctgatagctccttgcttgtttaactactaacagcacaatggagatagaatttcacatggtgaagacaggaggataagatacaaagcactgtcaaccttttagatatgattggcttcaccagtaaattatcagcgaaggatggatttttcccccaagtacccactagacaatacatcttcccatgtgaacttaaaattacataaactcatggttagtctaaatatataatgaacggagatcacacaaccaaaacaaaaatcaaaatggaaaagattataaaatacgtagcaataaacctaatgagaaatgtgcagaccatataacaaggcttgaggaaaagaaaaattaagtacgtggttggagaaaattcaatattatacaaatgtttatttaccccaaattaatgacatttttggctgtcacaactgatagagcattaccggcatctaattagtagaggccagggatgctgctaaggatccctgctacaaagtacagggcagtccagtgtaaaatatcaatagcggagaggttgtgccctgaactgtctttaacagagaaaatcatgaatatagactctcttatgggtcaagtataatttgaaaacaaaggttcttggcccaaaggtttagattttcagtcaagatcttaaatttatttttactttcctataacattaaaggacagtttgagatttttgtgtttatcaaagaggaatgatagattagaaagtctgtgaaacattaggtggtgattaaagaattatggtgcttaaacctgggtagatgttaatggttcaataacatttttaagaaataagataattaagagagaagatttggcaaatgtgactgtatttacaaaagatccttgtagcttttggctacgtaacacaagcattcctttgttttattcattgtttgttccagatggatttactaaattgttcagagaaggggacccttattatttacctgtcttatagttgcatacagtaggaacataggaaaggaaccaatttagtaatgcatttggactcaaaagttaattctgcaattatactgggaaaaggaaggctaaaaaagacagaagctaggactgtaaatgattgtgggaccctgggtataaacttccatggataggatacaaagtcactgggatcaaacacatgcattggcagggcgtaagagttaagagagcatctgatttctaagatgaagactagtaatataaatagtcttctaatgttctaatctgaagtgggaaatatttatttgaatatataaattttgatatgttggccaattcaattactttgtagtcatgtctccttgatcatgtaatttcaaacatttttgtgtaaaaaatcattaagagcggtgttactccatataaactgttgtaaattatcagaagttagtggaggctgccatgaatagatttatattgtatgtaatggtctgattatgtttttttattatttctctagtaaacagagaaggtcaagtatttttaaaaatcacaaccctcaatagcatgtctatttcacactgcattttctggcctacaccaaactcacctaatttgcatattgagatataagtcaaatgtagttattcgaacctattatgtgtagggccatttggacaaccatacaaaaactttaagggaaaagtgtaccatagtcagatggcatccccatgactatgggaatattccaaaaaaaaatctatgggttgattaagtaaagatttactgggcaaaactgtacatgcatgccttaggagctagttaaggattttttgttaatatgaaggttggagcaaacaattcttaaattgacttatgattccaggtgtgaaagaccaattcctaactataagttctgtggtcttaagttacgtgccctatattagtttcctaggatttccataacaaagtgtcacagactggatggattgaacaacagaaatttattacctcacagttttgagggctagaagtctgaaatcaaagtgttggcacagttggttcttcctgagggagaatctgtgccacacctctctcccagtttctggtggtttactggcaagctttggtgttcctgggcttgaagactcaccctaatctctgccttcatgttcacctggtgttcttgctacagactgaatgtttgtctccccaaaatttctatgttgaaaccgaatccccaatgccatggtagtaagaggtggagggggccttcggaggtgattaggtgatgagaggagagccttcttaaattagattagtgcctttataatggagatcctggaagcctcctcctcccttctgtcatctgaggatacagtgagaaggcagtcatctatgaaccaggaagcaggttcttaccagaattcagccaagctggcacccttgtctcagacttccagaattataagaaataaatttctattgtttataaaaaccactatatttataataatattgttatagcagcttgaatggactaagacagttctacctgtgtgcaagcatctaaatttccccttttcataaagattagaggtcagattagagtcacattagaggtccaccctattctagcctgatctcatattaactaattgcatctgcatcgaccctgtttctaaataaagccgctttggaaggtactgggaattaggacttcaacccataatattccttatgtttagtttttttccaatactaggtttaattaatttaaatgattagggataattaattttatcatgagagaatacttatatgtgtggagagaaacagaaatgtttaaaaatgtggagaatgtaacaatacttccaggttctgaatactaattgcctccaaaaatctctacgaacattactatggagtctactcacttgaagcagctgaagtagatgatttgtctaaataaagtctatcattttcttgtgagtctaataagggaatacatatcacatagctgtttaatataacctggcattgaaaatgaggagaaagagaaagataagctaattgttgcagttgaaatgtactgatttgactatttcttaggagatactggaggatgaaatgcagaactttataagatgaggagaaatgattgcttatactgacttgaaaatagcatttagtttcatgttttgctgcatgagtataaacaccaattgtaaaatgcatttcatgcccagtatctgatttgtcaggaaagcaaataagatattgtttgtatctttacttacatgcataccatctttcagtgtttctcttttgtcttccttagtgggaaagccccctaaaacagatatttttcttgtaacattttataggtattgacttaaacaccattgatatctgaacatattgattatgtcactgaaaaaaatggctatcaagacatttagtgtttatatacctgatgttaaaatctttttaatgctgagttgattcgactagtgaccccaaccctaatacttcttgtaaccataaaaagcagtcttttaaaaattgtaatacctcatgaaacactagttttaatttacttccccttgaaagacctcgctgggaatatttgcattgtcagcagcttaaattgaccacagagataataactaaataatttagaaaaccgtaagatgatttaggcatttaagatgtgtataaggtaattaaaaccaaactttcggaggggtaagacctcactgtagttggttattctatagctggggtcactgcctaagttgtatgaaggcatatgttcaatttacagttgtaatgaggaacatggggtgttttgatccttcatttgttgtgctgatctctagaggatgcaattgcctgtattaaacaatgaacatggactcttttgtggcggataataaaaatgtgtaagataatacgtgccacgtgcatgtatgtttggcatgtggcttttctctgtttatggaattgttgccctttgttgctatcatggaacaggctcatggaaatgttcattattagccacttaggaacaagaccaattcgtttgacctcattagtttgatcatgattattccattttaactaatacatggtatttatgaaggtgttttccaaagattattcacttgcaagggcattttgtgttttattttactattctgcaaaaagacaaatagataaagtttaggtgataaagttttcttttgtcacatgttgaatgtagtaaaagacaaagcaggtttttttctgttttttttttattttacacttaaacaatgaatgacatcagggtttcagattttttctatatgtcgatacacttgaaaatactagcacatactcttgggataaactgaaagaaacatttataacatcatattgtgatacaggttgaagtaggaggaccagctttttattcagtgaaaacttgcattcatcccaatataaagtttgcaaaaccacagtgagcctagctatatccagggccctactcttggcttaaaacaaaacaatgcaaatgtaatctttcaatggtaaagaacatatgaaagagaatgatcttaaaacctctctaacttggacaaacaaacaggtgaagaataattggaattggtgggaaatataggaatagaaaatgtttttatgtcacagcttcatttaataagatgtagcaaacaaccatttggtttttgcacctgcagcactgctgtctccttggtgtactcttcttcactagttgcggttgtgtgggctgccaaaatcttcaccttgcctctctgtggtcatgtcactgaagattggtcaatcacaattcccaaatctcttatactgattggtctagaggttggtatgttatccaaacctggccaataagagttatatctaggatgtttacctttttggatcttgtagtaaaggagtttggggttttgggttttggagtaggaaagaagtagactagaagcaatctggcctaaccaaataaaaccaatgaagggtaacagaaaatgaatgtctgagaagaagcagatcttcgttacttcatttctaagtactcatagaactcagagttcctttttctcctgagcatccttcaaagatattcctcttcctttttatttttttttcagtttaagttggaaaagtcctgcttcatgaaataaacaagaactcttaatcaatatggtatctgtttgcatgtatatgtcctacttctaatgtactagacatcttctcttaaatattttaagctacatatataactttatttagacaaagtttggaccagctgaacccttcagtaatatgaaaaaggtaaattttacttcactgaataatcacaaaccttgaattggcagcatccaaattattagaactgtgcagcattaatgctgatctatgtaaattgggttcataaacttgcttgggccctggaagcaacttgcattattatgtattttttctctctaattttcaaatcaaattcattggtcattcatccccttgaaatcagattctgcagccacctggctttcctccaaaagtcttccattgtttcataagccatcctcgtttccaattcatttttctttatccactgtgtaaattaggtggacctgaatatttagaaaagattgaaagcatttggttgttattagagtaaagatagctaactcacacatgtgaaacattagagaaaacttacaaatgtttgagtaatttttttttctgttgttgttgtttggggctgtggggcatttaaccacatcctgccatgcacacacttgagcttctctctttattaccaggtagagtttctgactaataaaacaaacaaggacaatattttaattttcttttcccaacatttttattgtttttatttaaatgtaacatactatacactgttcagccttttgcgagttaggaggagggagtgattctatatctttatgaggagtattctcagaaccaaaactcaaatggacacatatttgtggctgatgcactttaactttgtgggcctgggaccatactcctacagaggcagatctctcaatagctccaatttttttttttttcaaatctacaacattcagggctgaaactgcttttttttttcttcagtagttgcaaaagggaccagaattctatttccatttcaagcaaatatgccacttttaaatgcaagagaatgtcattactccttaccaaacaatctttctttctctctccttccttccctcccttctttccttccttccttctttccttgcttccttccttccttccttccttccttccttccttccttccttccttcctgtctttctgtcttttctctctttcttttctcttttctctctttcctttctttctggctctttttcacccaggctggagtgcaatggcaagattatagctcactgcagcctcaaactcctgggcccaagagatccttccgtttcagcctcctgagtagttgggaccacaggtatatgccaccacgcatggctacatttgttttgttttgttttgtttaagagaaggatgtctcactaggtttctcaggcctgtctagaactcctggactcaagccatcttcccacagtctcccaaactgctgggattacaggtgtgagctactgcaccaggcaggttttttgtctttctgtgagggaaatgtgggagagacagggagatgttttctatttttggcctctgcaagctttaatatattttgctagaagctgttttagtgtcttgagtactataatgatgactgtttacacatagtctctttagtaatctaaatgtctatgtgaaataagaatccagtttgtgccctgtttgctgttactgtggtcatccaatgtgtatttgtcttaccaaacatttaattttggttgtgggtggtctatgtttatgtgtcaggtgcaattattattttaaaataaaggaaaaaaagatacctagttttgataggaatgcattacattatagctcacagactgagttaccaattaaattttaacatccagattccaaccacaaaaattaaacatttttataatctcatttgccaaaaagcaagttggaagcaaagtatgatgaaatgcaatttaaactataagccaaaagacagtgcctcaaatgtgtttcttctgaaatacagtttttttgaagaatgggaaaaatatgaccttttatgggattatacaaaaaatttcttaataaagcaatttttaaaaataacagattaactggaagtgctggttaagtattgacacaaataagtttgttggagaatcacagaacgccagcatttccaaaggttaaactttagtaagacacatttagtgagtctttttttttgtaccaaaatactgtgtccaaacaataaaatgctttttcaaaacaagaaatatgaagataaaactgcagcatcaatatactattatagttattgcttaaaagtatttagaacaaatagtatttttctacatttttaaaatcactacagacactgcaaataaggcttatgtatttatttagtggaatacaatgtgatgatgattggtaaactcttatgtactcttttctatacctgctctaacaaaatgaattttgatatggttacattatggaactttgtaaagctctttaaatttacagaaaacaagttttatttggttttgtaaagactagatcatacagctagaacaggtttttgtatatggttacacatataccagtatatatttgatttgctcagtttaagcccctgggagagttgcgcttcataccaaattctttgatagttcctttgggaaagatgcattatgtggaatttacagagggtttttagagatgtggacagcctctttaccgccatgacatttggcaagaaatcatgagtaaataatgaggctaggctatttaaatgtatttagcaattaattttcctttttttagtatattcttggaggcaaactgatgtattgaaagagaagaatttggccttctggtctatttcttgagacaggaagcctcgagagtaatatatgttttcaaatgatagcagacatctctcactcaagccatggcacagcattgccatatttattgttgatggttattactgcagaagtgcaaattaagtcaactgatagcacacgggcactcatactgcttccctaatcccaactcctatttttgaagtgttcgccaagttttaaaaacactttgtcgtgaacatgcatgtggtgtgctgaataaaaagaaaagataaatcagaagacagctgctgagatactctttaaaaccccaaaagatatttaacatcctattaaataaataacttagaaagaaatagaaagggatgaaggcagaatgcacaagcataccatactatttgtattgttagaacagtttcacactaacatgtttatatttttaaattctattcaattattccatgagaccacatccagaactcctttggttgtgcatatgatatgacccaagtgctttccagtaaatgcttgcatgtattactgttcattgattcattaggcttgaatgagcaatgaagtctttgatatgagttcgtattccataaataactttcccgaagatcgttctttcaacagattgttctatgtcctttaagttctatctcagaggtttaaaaacaaaaacttgacaacaacaacaaaaaacccagccacaatgtttttcacttgggaataacttctatcccattcgatctgcctatatcttgattataagacatgacacagaactaattaaaagaacatcatatgtcagcagtgaatacaaaaaccttcaaaggctggctttcttttaagcaagcagacatctgcaacgtgtctttgcctttcaatctactgtcttcatgaagaatatccactattcttggcaaaagagccattggttctactgcatccacaaacgttgccttcctctatgagtgtaccaccattggaagaaagtgagcagaggtgtttttccttcgtgttttctgtcctctccttggagctccttttccattcaatgccacatacatttgcctcccattatgctgccagttaaatgatgcataggtattgtatccattttcctctatcctctccttcagcttacagtcattgttaaattctttctgcaaaggaaaaacagaatcttttattcctatggtgattgtacttgatttcatttgatacaagccatccagagaactccagtccaaggattctgtttgtagttgccatttgtacctaagttgtgcacttaatacataatgtcaacaatagaaaagtaaatctcagaaccacaaaacacattctgtttgaaagcacatgatacattttaattgatcatcatagccactttttgaaagcccttttaaaaagctgatgtgctttgaatattatatggtttaagtgcctagagtgattgtcaagaagtagacatctcactaacaatatttgtgatgagtcagtaataaagaatagtgttataatgcttcttttacagtaataaccaggggccccatgggaaaaaatagaactgaaggaaagatatgggcttgtcaagtttgcaaactttacctacaaatccataataaatacacacacacattcataagaaagcagagcttatagcaaaaccacaatagttctgcataaccaaaagggggggatgtctttcttccaaatatcaaatttcttaatttaatgaaattatttgcaatattctatagcttggaattttgacagattttgctcgtgaactctagggattgaaaactaggacatggaattcctcgttttgtgaactactatgttgaagaaattatgagcatggtgaatagcaatgcctacattgtatcttaaggacttggatcctgggaagttccatcccatagccatagagctttggttttgttcaggaggccaattggatttaaggagacattcctggacaaggcttcgctctcactcactccacaaatccaggttcttactctggagttaataacaaagaggaagtagctcaatgatctcaagactctggctttagaagtagcctccgcagtgcctcacgcctgtaatcccagcactttgggaggctgaggcaggcgaatcacaaggtcaggagttcaagaccagcctggccaacatggtgaaaccccgtctatactaaaaatagaaaaaattagccaggcgtattggtgggcgcctgtaatctcagctactcggcaggctgaggcaggagagtagtttgaagctgggatgcggaggttgcagtgagccgagatcattccactgcactgcagcctgggcaacagaacgagactccgtctcaaaacaaaacaaaacaaaaacaaacagaaaaagagaagtagcttcttttcttatactcaaactaaagtagttaagaagctaaggaattggagcacttgccctctggttctatcttcttcatccaaagcaagggccccgtgggcatagttcagttgaggactgtacttggcagtttctctcaccttgagactttttgaaatttctacaaaattccaaattcctgaaaatgtatatgtttatatacctaggtgtctgtaggatttatcacagtttagaacattatcagaaccataagaagcagatgtattctatgttaatgctaccagctcaagttatctgtcctgaaattttttagtcttaaatgcttctcttctataaagtaatatttaaatataacattcaaatgatgatttaactggctgaaagtaagaaggaaaggtaaattatttaaggtaaggattttgataaaacaaaaataattctgtatttgaaaggaatataaatccttagtgtggatttacttttattctctttatctcagtctgtctaaaactatatacttttcaaagcagagtaatttttaaaatatggataattatgttcatttcaatcaataaatggggtacagtttagagactaatgaaggactgagattgtttgaggtgatttcatatttcagatgaagctaggtatacaaaagtgggagtgtatgcttaatgttaattttcctccccaaaattaatttatagagtaatgtttcttaaattgaagtgcacatgtatcagcctttttatttcagatgttttaaatatttgggccaaaggtaccaaatctctagaggaggggcctcaaaatatatgttgttgacaggatctaagcaaatcataagcagttatgtataaaaagaaaattcaggctacagcaaggactcaaaagcagggttcagggagtttttttaaaagaagtttggattttttccagctacctgaaaattttctttggtccttaaatcatgctctatgaagacctattctatttaattcagttttatactttatttactgaatcccatcagtcaggagaaaactcaaaatacaatagataaattgcttagagaatgaataatgaaaatataagaaaggtatacagtttccaaaaaggaatagaggaagataattcaagagaatagatataaaactggtttaatcagtcagtctgaatctttgcccaagtcagatttttaggagggcttacggaattgatggatactgtatgaaacaaaaaatgaaggtaggaattacaagagttgtcacctaatatacagaattatattagatatgcacttataaattttgatgttagttctattccactctgagcagaatattgaacttgaataaatttttcgtttaatttgaacaaaccataatttttcattattcctagtagaaatgtaaagttacacaaaaaagaatgttatggttagagaatgagtttctttctgagacaggctggaagtggaaagtatgttctgtaattggctgagcttctaccagaggttaggtttatgcagtgtataactgtgctctgtatggttctaagtgctgaacaaatagtgggggacaagactgacctcactctctccaaggtcacaatctattgggagaagacagtgaacaacaaacacattaatgagagaaatctcagataagtgccactgcagataatagaaagccaccggactctactttaaataaagaatttgaatgaaataattcacagagcttagagctcaagatgaagcataagcacagtccatgagctgtgttggggcagaagaaaaaaagaggagaaatgtgaagaaaagtattaaatatttttatgtcagagtttatttgaaagttatccatttctccttgatgtcatgtttttaaataagtatattttatcaattaaaagtatttaaaatcttttatattcattaaaattatttacattttcttccttaatctaaattagtgttagctggctttaggacgttgggtctagactaagtatgtgtgttgttatctcttcaaagaatatgtacctggttctcttccccaataattctgatatagtagatcaaggaagaacctggacatgtttaatgaaaacattaaacatgcctcaaaagagattatgatgtgaacccctaaatggaaccactttttataatggtctgttattcctctgggttcattaggggagcaatggtaatggagaaattttactaaaattcctctgacccccatgcaaaaaaaagcatttgccctagtcccagggaccaactcaaagcatgcctgactccccagttaaaagtggacctgatattagtaaaatacaaggctactctacatccagaccagcggttctcaaattgtggttactgcaccagcagcatcaggaacacctgggaccatgtgagaaatggaaattgaactgcaccacagacttattgaatcagaaaatatggctgtgggtcccattattctgtcttttaataagcccttccactgattctgatgcatactcaagtttaagagctgctggttctaaatggtcactaaatggttctaaatggttctctcagccttatgctaatcaacaaagtaagtttatttacaaatttaaagtgaaattcctttttgattacataaaaatgtaaaaatgacacaggatctgtttacaaaagtaaaaattatttaaaagatttgtgtcacaggttttatttctggccatatataatattacatgtcctccaaaaaattaaattaaaatttttccaagtttatagttgccttcaatacactccccttcagtagaatccagagaaaaaaatgaaattcagttagcatccccttgatctgtctctgggagggacacaataagatggatccacatgcacaaactaatatactcctgtcatcattcaaatgacagctaagagattgaaacctagttcccaactttattatagggctgctttgctatagctgatcctttcatacatgtaacaaccaatcatgctgtaattatttcatatttgttaacatttcccctaaatatattataaattatttgaagtcaaggcccatttctatacttctttcttatgcatctttgatatgtcaaacaatatctggcatatagtagatgttgatatgattgattgatgcatttttttctaaggacttgagcaggataaattgtctcactgcttgtaatttaattattattacaattgcaattataaaacaactatttggcattttaagtgagatcttaaatttctaagaaattggtttaaaagagtttgatccaagattgcagaagtggtattccaaatacttaacacctggtatggaatataggcatggatgtgcccaaagcactgcagggatacctgctccacaaggaccctattgcaaagaatatttcccacatatatatatatgattttgaggcataatttgaattaaaggttattgtctaggtaaataaaattctagagttgattgaacaacaagcaaaatggtgtttcttgacacatttccccatttcagattttaacaaaatgcaaaacatctgagcccttgtttcatcttcagccgtaacgcatatataatacatgggtttctactcaattcaagatctttgtttttagtgttttttctccaagttgtcttcattttccatgccaatctgaccggatgcttccgtgagagcctgacttggttagcagtttagaacattcacagacaaatgccagcagcagcctgtgtggtagactaatgggtgaacaacagaggagattacagaattggaagagctgctttgccagcccttgaaacagtggtgactaacccactgtggctctatttactagcaatagaaggataacaaagctattcggtgtctggaggaaactttccaaaactatggtaatggtttactggagtggatttgaaaacaaaagcagaatacttactgagccatagagtttccccttcttgttcatggctaagtaatagttgctgttaatggctttgacggcaacaactccgatttctactgatgttatctccaggatgcctaaaacatacaattttaaaaggctaaataaagaatcctaaatatatttggaagaaaagtaaaatcaaaagaaactattgagttgttttttgtgtggttctaaaaacaaaaggcacaaaacattggtaaacaaacaagcaaacaagcaaatctttttcaatgtgtcttaaaacccggcaagtatttccagcaaatatatagaaaaaagtaataaggctttaaaagaattccccttcattttactctgagcatacatagaaaatattgttttaattaaaatgcttcctttgctaactctgcattttcaaccctataaatattgaaacaactctactcatcttagcctagatttcaaaataacttatcagagcccatatctgtactatggtattaaattaaatctgtagcacatgtcaataatatgccagattacctcaatctctaaaaacagtgataaactatttcttcttgctaggatatagataatctaaatctcttggctacatttaactgatagattcatttttggcaaatgtgttgacattctgagatacagggagactaatcccaacatctgcactgtccctgaaatagcagaattactgctctgtgttgggggaaaatccataaacatggatttttaaggtttttttttttcctaggaaaaatggaaaatcgagggaagtagtaagaggtagacaagagctccttttccccttatacacaagtttcgattgctgcatctaaagataattttctcggaaaagtttgtagatcacaatagggaagtcagtttatcgtctactaaaagtgcccacccattttagtttaagaagacctagggaactaaaactacttatttcataactctcagcagtttgttcagggtagagaagtagcatcgtgattagcatgtggcctctggagccaaaatgtctgggttcaactcctggctctacatttattagtgaattaccataggagaagtcactgaagtgtcccatgactcaattttatttgcaaaatgggcaacataatagtacctccctcataattttgttgtgaatattaaatgagatagtacctataaaattattagaatttgcctggagcttagtatcttcttaattatcatcagagggtagtttttctccaacagtgctagattttggaaattcttcaatgggctatgtaaatcctgaacaatacatacaaattcccattggcttaatacatgaaatctgaaagttgagcatattatcatttgtcatgtatcatgagaaacaccatccccaatgcagtctacagattatatgttttcactcttcccatagagatagagtggcttagcttattctcgagagatgaataccttctttcctattccttcacaggttagccttatggaggccaatagaaatgcttgagtttcccctgttgccaagttgacataaccagagactttgccaagactacatgtcagagacccttctgtccatgtatctgtaggaagtctctgacctaacacagcactccttttcatcaaaagagatatatctcactctatttgcaagccaaaaccaaggaaagattgtgaaggatgaaggagacattatttgtgtttttttacatccatttcccttatgctggtagtttccctaaggtacacacacacacacacacacacgcacatttatttgcatattctgaaaaatattttcttaattcacacaatagccctctaaggatactgttgttagtctcgattacaaatataaaaacggaagatacttaggttatttaactcacacacacacaggtggtaaggtgataaaggtcggtaataatggatgttaacacttaagcctctgacttttagactctattgctccccatctctgactactttgcctctccatcacatcttcctcctctttcccattcctacaagggaaccctgttgcaaaccatctgacaaaatgactcatcaagataattttctttaatgacttaatgtgctgttcctcccaaggatgatggcatgccatagaggataacgtctgaatcttagagaacaaaatctaacatactttatttatgtcataagcagaagatacagagcagagcaggaggtagaattcaggggcaaaagattaggcagctgcttacattgtctggccaaaagacaagaaagtactgtcagtaaactgcaagatattctcttatgtatacttttgaaactgaaaattaatagaacaaagaggaatgaaggatgattttaagcaaaaaataaaccaatatttgtgaaggtgcatgcaacgtcctgggattaaactatactaacagactgagctatagtaatagtataagatacaactgaatttttgacccgttatttctgaggatgaactgcaagtggtattgtagattatatttagcttagatacccctttgtttctttctgctttacctgaaatgggagcacaatattcaaagactcaatcaaccattttttttccactttgcaactagtttaggcaagcttaaaaaggtttagctattatttttatattattatttagttattgtttcaaaatagagggaagacataggtgatttaatatcctttcgaattttgaaaataattttgggacgcagcgtatggtcaggtaagttataatttgatcatcttgtgagtaatggacaatgactgcacctattataaacatctgtgaatgtgaaaggggagttctgaaggactgaagcctagaggacttctttactttttgtaaggaatcactccagtttttctgttctttggtgaggatgatcaagtttgcctatcaaattatttttggaaaggagctccagaattttgtttgaggattgttggatcagtagcttatagttctatatgtgtatattttgaatcaaaactaaatgccagttaaaagagcctcctggaggaaagtgagttaagggcatactggatctccccgtgtttcttacaagtttatgactctacaattaccttaacattaaaagctataaaaaaaggtttttttttttttaactcaaagaaacacctgaaaattatattattaatgaaaggacacatgaattatatttcccattcatgtaaaacagatattttgtaaatttataggcatattcttgtagtgaaattctattatttatattaagttgtaactatattagtttttatgtcccttaaaacatgaatagcccaggtagtattgtgaatctatttaagggtctttggacaatttagttcaatcacttaggaagacctaggaggagaagggtacgcttttagaaaatgaaaatataaagtcaaatacgtaatggcttttctattgataagtctatgtactattgggaataaaagacaaacacagataattacaataaaacatgttacatggcagtaagtgatgacttaagatgatgacaaggggactatggggcaaaggtaaaggcaggtcatactggctggggttccacgatcaaattattgttggagatgagacctgaactgagtcatgaaggttaagaagtgtccaggggaaggctgggaagggtgggaaggcaagagcaaattattaaggtaaaacagtatggtgttttcaaatatcataagaggtttgatttaccaactggagtacaaggaacaagtcaggaagctgggaaaagtgaagttgggagataatgagactcagtttagtaaacatcttgtgcagattctaagaattttggcaactaggaaggattttgtctacaaatataaaattgtttaaagaatacattagaaataaagtaatatttagcaaatttcttcagtaaatagtagcaatctataaagcttattttagattatatttaaaatcttaaaaaataaagtttgatagtcaacattacaaaagcgattatgacaaaaatcagttcatattactttgcgaatgttccctcatgatgcatcatcaccttagtaatggagaaaattttgtgacttgataatctctgagtggaaataacttagaagtcacaattttcgtgtaaatgcatttttttcttttaatactcatatatataattgtttgggctggtaatgttttgatgagtgactaaatagttaatctgagaaggtggccattcacaagcatctttcccagctgctgcttctcattcttctccagaagaggagcatctgacctattgtccccctagcaatcatgttggacaaaggcttcttctgttttggtgctattagaatgaaaaagctattggtctggagggtaagtttctcactaaatatttttccataaacacaaaaggagaaagtatatggcaaataaaacttgtatttaatagaatggatatagacaaggaaaactagatgtgaaaaataagtgcaaaatccttctatccactcctagataaatagaacataaatatacaatggaattctatagactgagtaaattaattcagctaatgtgtattaagcaccagtgtgcagggtaggtgttagctctcattctgaaggttacaaaggcaaacaagatgtggtccttgcctcaaggagttttaaagctcaataaaataaagacccaaataagtaatgacaatacaaaaaaaaaaaaaaaccagaaagaaaatatattaagtgtggtatgagagataaaatatgttatacattactttaaatagtgaagccatcctgaagaagacagctggtgtttgaggtgacttttcaagagcagggttttaataggggggatttgggaagttgagaaggaacattccagggagagaaagtgcatgcataaaaacaggcttggagagagaaagagctcaagtgcttgagccacatttctccccacctcccccaatggcactttgaggtggccactagctaaaactaaaggttctgcttcattgagtggtagtggtgcttttctgggtgaggaatgtactttccaaaaaaaaattattgtgaaacgtggaaagtctcattaattcagaatcagtcacatctatttttctctaaacattttaacttgaaattgattataatgctatatagttttatagttttaatcaaggtgctgaaacatatcatagttagcacaatgtaagacacaaatactaacctctctaaatgaaacctctctctcccaagaattgttgtcagtgtcctaagttcatctattatatcctagcacagaaggacttagggagctccttggggttgttatcacattttcactaatacctctgggattatgtggccataccatagtgtgagtctaaatggctctaaatgtggttttacctctctttaaaaatgaaacaaagttaaatgaagtgaagcctcaaaacattatgggaactgtaatgtcccatggaccaatattggaactgggccacacagcgggaggcaagccataggcaagcgagagcgaggtttcaactgtatttagccactctccatcactagcattactgcctgagcactgcctcttatcagatcagtggcagcattagattctcacaggagtgcgaaccctactgtgaacaatgcaaggaagggatctaggttgcacactccatatgagaatctaactaatacctgataatctggggtggaacagtttcatctacaaaccatctcctcattccctttcgtgtaaaaaattgtcttccacgaaaccagtctctgctgccaaaaaggttggggaccgctggcctatagctcatagggttgcaaagaatctcagagagtgggtgctaaatatatatttactgtgtgctcaatcagaatagtggcaagttaaccaaccttctataccaatagttctcaaatatgaacgtgcatcagaatcatctggaagacttgcttaaagacagattgctgggatttttgacttagtaattctagattggagtagagaattagaattcctggcatatttccaaacagtgctgattctgcttttccaaggaccacacactgttctatacaatatgattcagagacaaagcacagctttgatgcaaaaaagcattgacagaacgtgtgcatagaagcagaaccacagacaggaatacacacaagtaatagcggcagcttaacaacaagaaaaattttaaacaatgtggaaaattagtaacctcatttttgaacaggtatgggatttttaacatctacataactatggtattgtgaatttgggatttgtgtacagatatactgcattgttgttgatagtcatcagaatctttattttcttctccattttaaaagtgtggaaatgttggtggaaacttaagtgccttcaactactcataagaattttatgggctttttcaaagggctaactgtgttaacaccaagaattaaaggactatatggcccccttaaatatatgcacatggtcaagaaattgtctcaaagcaatagggctccactttatccttcaccctacacccagtgttgaaagcatgtattaatacttgctctagaatgatctcattgccattaaaaggagggtactagactgggctaatcagtaatctatgtctagtccacctcctaccattatacactctggttgcctttttagtataatgtatttgagttatttagtttctctatcttccacagttctgtcaatacgcttgacatgcatttggaattacagatagaaatgagatctgaatttgcagaaaatcctttctatctctggataagatgatatatctttcacagtatgctaaataccaaaatgacattttacattctcacctgataattcaagtcataggataaatacagtgcctagcttagccttattgatgagtacagtggcagatcccaaaacacttgtcaatttaagactatatttaaccaatattgtcattcagccattgtcattgatctaacattaaaagtatcagaaacttacaatgcaatatagggacaatattcttaagtggtaaattaattgttaaagtgtgttaaagatcaatttcttactgcatttttattacaaatgaaatatgactccagatctttcacagtgatcataagtgaacaaatatttgcagatgaccatctaataggtttcttcacaacactgtgctagatcaatagatttggtaaacttgactttttttttctaattttttcctcactggtagagattttttaaatgtatttaacattatggaaatatttcaggaaataattacttatcaatattgtaataatgtcatgttttcaaacattatcctctctgttcttaggatacattcacagtgagacacaaatgacacgtgtctaggacagaaatggatttgtaattcttgagaactgttcataataagtgctgatataaattgaattcacaaagtgtgaaatgattctatcgctagttttgggtaaaataaagatctagaaaagcttgtgttcccctggagatagaaactctacccttattcccaactaccagcaatccagcaaacaaacaaaaaaacaacaactactggaaacacttacatgtttgagtcatttgctgtgacccaagataactgacttttgatcccattttgcaatgggataaattgcgggaaatggtacaagacagaaaagttaagaaaagaagcctgaacgattacgttagaaaagtcctgcacaattcatttgaatggtaacaaagccatgagcaaggcagagagtaattcttcccgataggtaaacatttctgtatcagaaaacatatttctatataaagttttatgtagcaatttattggtttttctttcccctcatttcctttagtagataactcaacccttcaaaaattctgaaaagttcgaaatcctggctttttgccagagcatcatggccacatcccacttttgtctctattcttatctaatgcatttcatattttaaggaaaatcccaagggaatctttgtgtggtttgtgtcttctcgcgagcattggaaggacagaaagtctgccagtctgtacagaaagtttcatatactgaccatgcaaaaataaggcacaatcattgcaatgttatcacttctgggaaaatatatccagaatgcaaaataatgttagaaacatgttatgcatcagtagaagccaacttactacctagattagatctattatgatacagaagctttggcaagcatgtcaactgtcatatttttccccaaagtactaagttattttacattattttgagatatcttctatgttcaatcaaaacctctgatcaatctaatttgagctaaaattactaaatttaaaaaatacttgttattttagtgagaaaagttcagatcatttaaggcttggtcttagcaaattgtagagtcagagaagatttcgaagaaatctagatattgtctgtttcatatccaattctctttcgtaatagatgacattgggaaatccagagagattgagggacttacctgtaaaggttacttagagccttaagtaaatacttagtctacctcaccatgaggctcctgctaacatttacaaacagttggcagccaggcaaagattttatatcttgttcattacacagaaacaattcattctatttgggcttggccactgcattttatttataaagagagaaaaaaaattaagccacataaagggttagaggagttactgcatggcatattttaataaatgatcaacatgttaatatagacatttaccctaaagacattgctataaactgtctaccacatttactcaggtttttatgaatttctttaatataactaattataatatagagtatcttttctcctcaatttaaggaaaataataaaatgggtcagtagagcacatcttgatattgggtttcctgtaagaaaaagtcttacttgatgcattaaagtgttcacaaatttgctaatcatgaacagccctgagtagttttaaatacttaatatggaataagtttgaggggttcaagctgtaggctcactttgaacatgtgtattgtaaatttgacaagcttccaacatggtatagaataatacataattggcctcttaattccttcaaagattatttccatgattacttagtgggtaatcataatacttataagaaatatatattccactgtgtggtatgtgaattttgatttgattgtgcagaaagacaatttatctatttatgtatacttgacaaatggcaacattgattcatttgccataactatatatttatgtaactcaggggcctccaaccactgggccatggactggtactggtccatggcctggtaggaaccaggctgcacagcaggaagtggccggtggtgagtgagtgaagctccatctgtatttgcagccactccacagctactgcccatcagtcgttactgcctgatctctgcctcccatcagatcagcagcagcattagattctcataggagctcgaacactattgtgaactgcatatgtgagggactgggttgcatgcttcttatgacaatctaatgcctgatgatctgaggtgaagctgaggtggtgatgctagcactgaggagcagatgcaaatatagatgaacgttagcagacagatttgactgcacagagaccatcataaatcagttgcttacagactcatatcaaaaccctatctgtgctgcatctggtgtcaggctttaagtcagaatctagcacttaatttagtccatgtatggcccatccattattgtatttaccacttccacccatgcttctttcctgcactgtgcacttgtttcagtcacagttttggtaagccctcaagctaacccagccaaaatgagtaaaaaacaaacatcactggagtgcttctttgaaggagggaaagacccagtgatgcaacagcggaagacttctaagactgcctacaaaaattcagcatttaaaagaaaataacaagagtcccacttaaattatgggttcactgcaacaggtgattcacattcattctgcaagcctgctttgtataatatgtgatgactggctatccaaaaaagccataaaacctttaaaacttcttcaccacatgcagattaagcaccctgtgtcaaaagtcaagttcaagtctttggaggttttctttttttttctttttctctactttttttttctttttgaggtagggtctcactctgtcacccaggctggagtgcagtggcacaacctctgcctcccggactcaagtgatccttccatctcagtatccctagtagctggaaccacaggcatgtgccgccatgcctgatttttgtattttttgtatatatggggtttcaccatgttgctcaggctggtctcaaactcctggcctcaagcaatccacccacctaggcctcccaaagtgccagtccattttgaagtttttcaaaagaaaaaaaaaaagatgaacatgaagaacagaagcaaacattgaaggacaccacttcatcaaatgtgtctaaactgagagcatcattcttagtggctaaccacattgctacagctaagagaccctttactattggtgaagagttgatccttcctgctgctaaggacatttgtcatgaacttacagaagaggctgcagttcaaaagttggcacatgttcctctttcagctagcaccataactagaccaattgatgaaatagcaggggatatcagggcacaattgttagagaggactaatgagtcaccatggtatgtagtctaggttgatgtgtctattgatgttgacaaggcaacaatgcttgttttagtgcaatatatttttcaggaggatgtgcatgaggatttgttatgtgcacttttgttggcaatcaacaccacagctgcataaacattcaagtctttgaatgaatatatatcaagaaaactgaattggtcattttgtgtcagtatatgcatagacagagtagctgccgtgactaaaatggctttctgatttcactgctcgggtcaaagaggtcgcttctgaatgtgagtctatgcactgtgtcatctacagagaaatgctggctagccaaaaaatgtcacttgaacttaacaacattttgcaggatgtgattaaaattatcaaccacattaaagtacatgctcttaactcatgtctgtttgcacagttctgtgaggagacagacagagagcacacacatcttctcttttttttgagacagaatctcactctgttgcccaggccagagtgcagtggcacgatctcagttcaccacaacctctgcctcctgggttccagtgattctcctgcctcagcctcccaagtagctgagattatagggtgcccatcaccatgcccggctaatttttgtggttttagtagagacagggtttctccatgttggccaggctggcattgaactcctgacctcaagtgatctgcccgccttagcctcccaaagtgctgggattacaggtgtgagccactgcgcccagctacatcttcccttatacacagaagtgagatggctttttaaaggtagatccctggccagagtttttgagttatgagaactactccagagatttttagaacaacaatcaccactggcagcacatttcagtgacacagaatgggtcccaaaacttgcctatttgtgtgacatattcaacctagtcaacaaactcaatctgtcacttcaggggagaatgagaactgtgttcaagtcagcaaaagggtctgcattaaaagccaaagtagaattatgggggtgatgagtgaacattgggatttctgatatgttttaaacattagctgtgatttataaagaggctgagccagggccttctttctcacagctggtacatgatcacttacctcagctttcaaaagcatttgagtattactcaaaagaccccaaactgggaagaaatggatccatgacccatttatgaataagccaggtgaatggactttgtccatgttagaaaaggatcaactgcttgagatcacaaatgacagtggactttaaaatatatttgagacaacttcaaatctccatatgttctggattaaagtcaaggcagaatatcttgtaattgccacaaaagcaccaaagagcctgcttcaatttccaacattctatctttgtgaagcagggttttctgcagtgacagcaaccaaaatgagattatggagtagatgggactatctagttgcaggaaaacaagctcagggctcccactgattctacattatggtgagttgtataattatgttattatatattacaatgtaataataataatagaaataaagtacgcaataaaagtaatgtgactgaatccccctgacaccatctccttcaccggtccatggaaacattgtcttccacaaaatcagtccctggtgccaaaaaagttggggaacactgctataacttataatattggcaataaagatttttggcttctgctgtaaaggagatgtttaatcaatatgttttggaaggtcctggctttctggactacagatcaccccctttgggatgattaccaagactgaagtggttctttatccctaaagtccatggaaatgtcctatttttgccacaactcacacttggcaaagaaagaaaacagaacccataggttggaaatacaagaagagagcatcacacatcatttctgactactaaatacaatgtgactactagtaaagcatgcagccagtattttgtaggaaatgttagagaaagtactttcatagaaattagtttaaagggttttcctggtgcttaaaaattgtattttaagaaagtaattaaacaaatattagaactcagcatgaaaatctgacattatagtacagataacatgggaaaagcaacactgggctagagatggtctaagaacaggtactattaccttaaccacatgtggggagggagcattactcattctttagtaagatgcaactaaggattgatattagaatccaacatatatgcattattgttttttgtaattaaatgtgggaaatggattgttaggtaagatgtttttctaaagctcatgaaacacttttattaagtcttgagttaacaaactatctataaagaaattcctagagaggatgagtgcaatctggcacattatgatctgtttcctcttgatagaaaagaccagaaattatcccattatcctgttttactttttaaaaatgcttacattgttttaaagtagtatgttcttgagaaagtgctcatgccctttaagaaaaaacatgatctatctgatccaatttgaaaatgaaaactgatgggtaagggacacattttatgtgggaattggtgctacaaaatcaacaggaaacattaagagagttttaaaaatgcaaagagaatagtaagtggataaaaataatgtatatccctatctatctacctatctatctacacacaaacaagtgttatttcatactcctcttggtgtcttagtaaatgattctaaatggaatatgttgaaatttcattatttaagaatagatgatagattaaaactactatgtacttgagttctcatgcacataaaatattgctgggatccagattaaaggacaagggacataaagggaaaggcaaaagctaaaagttaaaagagaagaaacactgaaaaaaaagaaaattattgaactgacttgactttgtatatattacattattaaatgcattattaaaatatatatccaagccatgttaactgtaaatgtctaactttcctcgtcaaattttatctgaaactgtcaaaacttttaaaacttagaagaagaatattgagaaaaacattaccttaaacttctttttaacgtacctgggttcagctagataaaaccgcacaatatcatatcttgaagaaatgtttttatttacatttattcgtcaaaatctgaaggcattccttccagaagaaagactctcttaatattatttattgcatataatgaattgtaagaaggactttaaattgattttctcaaatctgactagcttataaagtgttgtcagataattattaaattcaactgaaataaaataatttataataatgcatgatgattaaaatgttggtacataaatatgagacagggaaaaacaaaggctggaaaagactggacaaatttgaaaacaacttttcaacttgccaccaaaatggcaaaacctaattctaggtaaagtggttgactttttcaagtcagattaataaattaatgtaaacatctataaggaataagcaacatccaacagtttcatactattcaatttcttttgcaaatgtttcctctttttttgctaattcttaaagatcaggaaaaaaactgtgtgtaacataatttcaatgtagattattccttggtaaaattcaaagtaaaccctgtttatttgtttttatataaggatcttataaatgatatccaaatagacatcaaatttagtgtcataataagtgggcgaaggatatgagcagacacaaaagaaggcatttatgcagccaaaagacacatgaaaaaatgctcatcatcactggccatcagagaaatgcaaatcaaaaccacagtgagataccatctcacacgagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggattatcaatcatgctgctataaagacacatgcacacgtatgtttattgcggcactattcacaatagcaaagacttggaaccaacgcaaatgtccaacaatgatagactggattaaaaaaatgtggcacatatacaccatggaatactatgcagccatcaaaaatgatgagttcatgtcctttgtagggacatggatgaagctggaaaccatcattctcagcaaactatcacaaggacaaaaaaccaaacactgcatgttctcactcataggtgggaattgaacaatgagaacatttggacacaggaagggaacatcacacaccagggcctggggaggggggagggatagcattaggacatatacctaatgtaaatgacgagttaatgggtgcagcacaccaacatggcacatgtatacatatgttacaaacctgcacgttgtgcacatgtaccctaaaacttaaagtataatacaaaattttaaaaaaaagaaaagatatatttgaagtctctatatttcaacaaaatagactcaaattcagtacccatcatacagcatatatttcacagtcactattattcaataggtatgtatatgaatagatacacatctatcttatacaaaaacaggtcaaaaagcatttaaaaataaaaataaaacttaaccaaaacagaaataaataaaaatagacatgcccttaaaaagcttgagaaacttaattaaactctggcaaaccatggaaatggaactcaggaatagaactctattaagcaatttttccttatgtatagattatagctactgtgtagctgagcctatttcttaatgcactgatacaagaactaggtatcttttagtttagaggagaaatgtttagtgtgcagatttcaaactctttcaacattctgatctctgatcatgtagtacaattgagaagtatgatgaagaggatggcatatttagcttgaagttaaaagagatccaacttgcccttagtttattacgtatttattgttgagacagggtctcactctgtcacccatgctggagtgcagttccatgatcatggctcattacagcttcaacctcccaggctcaagcgatcctcccaactctgcctcccaagtagctgggactacaggcacaaaccaccatgcccagctaatttttttttttttaatattgtttgtagagacagaggtctcactatgttgcctaagctgttctcaatctcccaggatcaagcaatcctcccatctcagcctcccaaagtgttgagaccacccttagtttattgaaagcatacttctttcttcatatggacctcatctgcctctcttacctgatgctgtactaccagcaccgggatcatatttcatatgtatatatgtaaacaaattaataaatttatctgaagaaactcatgtgaaaagtacttgtttcaacttggcaaactcattttttcctagaaaaaggaaagaagaaagaagtgctcggtgttctttctgttcaattctcaagttgaaaggggacactacaggaaaagggaagctgttcctctgttggcaggtattccctatttaattgtgtctcaactctgcccagggtactcagtggggtaaaatcagaagcccttccagggtaggcaggactatagagcagcactccccacccactgccccaagttttcttcagtcttcagcgtggtttccagcctgaggctgaatcctcccattatttaacatatgcatattcaactcaaaataataaacgtgtaccatgagggactgactgctaaatgtatccctgtgaaaaatcacactgacaatatttgatgtttactgggtataaaagccatctacgaaacataagaaggatttcttgtgacttgtatgctataggaagagaactaataaaagagtcccaagcctaaaccagaattattctgctcagtctttttcttctaaattcacttgcttcaaccacaacaaaagccaaggaccactttggctcccttttcttacccaagtttgcagtcataataaccttttaaaaaaggtttttaaaaagagtcccttaaccacaaagtccaatatctcagtccacaccctggatattctttgtctcacaaacttggtcaaggatgttaaggtaataaggtccactgcaaacatccaaatataaacaactgcttgttgattctaaaatcctgatgagtgttttcatcttgagtgtttaacagctttctgacatggtaggatatcctatctttcttcctctagacaacaaacagctttctcatccctctttgccttctcagtcattcaacactttagctaaagggaggagcacaaattcttttctgtatgtggagacttaaagactactaggaagcacacaaccatttcacacccttcctctttcatcatcaccagctcctctttttattgtttctccaacttgcctgttgacaaagacagctgctaacaattgcatttgtggtactaggatatgcagtctaattgcataggcttgtggccaggggtcttgtccagttaagattgattttcaaaaggagagctacagagacatttccttagatgtcttcccactcacaaagttcaagggacattcatactatactcttaaatggctgcacttgaaaattgttttcatgttttgttttgtttttttcctttcacctttatgtaacccctccaaaaatcctggcatagatgttgagtgaagagagtactgctcattagaatcaacagttttcttttgttcagttgcccttgctggctaactactaaacaacgtaatcgcattggaaagtcagagatatttttgcctttgaaactgaagcaaaatggtgacacaaattctttaggtagcaaatttgctggcaaatttattacagacataaaaacatataaccagttgttttctttacaagatacttatttatcagattctgtacatttcccttaacccttacaattatcttatctatgagatcttaacccatactgacaatctcatgtatattcctaaaatacttttaaaaagtctaatggtcgggcatggtggctcactcttgtaatcccagcactttgggaagccaatgcaggaggattgcttgagcctaggaatttgagagcagcctgggcaccatagtgagaccgcgtcactacaaaacacacacagaaaaattagctgggcatggtgatgcatgcctgtggtcccagatgctcagaaggctgaggtaggaaaatcacttgagccaaggaggtagaggctgcagtgagctgtgattgcattactgcactccatctgagtgtcttttgcagcaacgtggatggaacaggaagctgttattttaagtgaaacaagtcagacacaaaaagacaaatatgtattctcactgataagtggagaggatacaaaattatctgggtatggcagcgcacacctgtagttgcagctactgaggaagctgagttgggaggatgtttgagcccaggagtttgaagctgcagtgagccacgattgcaccattacaatccagcctaggtgacagagtgagactctgtctctgaataaataaatagcctaagaagaggaaaaccttataagaaaaattatttcaagtggattccaacccagaataactagttgacgtatttgaagaattaataatgtagattgtgctcttactgttagtaaataggtgcatttcattgattccttttggttttaccaagtacagtcttttgttttgttttgaagtggagtctcactctgtctcccaggctggcctggctggagtgcgctagtgcaatctcagatcactgcaacctctgcctcccgagttcaagtgattcttctgcctcagcctcctgagtagctgggattacaggtgcatgccaccacacctggctaatttttgtatttttagtagacgcggggtttcaccatgtttgtcaggctggtctcaaacttctgacctcttgatcctcccgcctcggcaccccaaagtgctgggattacaggtgtgagccaccgtgcctggcctagtcttttctatatttgtagaagtagatctttctcattggctggcatagattggtgatagtttcttaacttggcatcactatctgctatttcatcaacacctccaacctaaactagaacgcatattcacatgaaaatttaaatgaaaaaaaatcacaaaaatgagcatgtacccaatataagaaacatttgctttgaaattgatggcttggaccttttaagtggttttggcaaaattaccatctggtctccaacacaaaacagctgttttaggtggcaaaatcttgtcaagctaaagctcccaacccttaagcacgggtaattggcaagaccttgttccagttcatctttagtccctactgaatctgggcaaacaactgtgaatttgcgctaaattcctcttcctataataggcagcctggcttcccatggagacacagagttttcagagccttagtgtcctcagggtatctgccagtacaaagctggtctaggataagccacattaatagcagtttcctcttttcattcataagctgtccttttatatttatgagctcattcttgtgagttaaatattttggatgtatttctgcaactttagtatttacccaatacttactcaaaaacagtaagttgtctaatcctttagtagtttttcaacattttcaaaagtattgcattttcaaaagaaagttaaaggagcattataaacaaggtgcaaggagacagtggcagttgagacttcgctttctcaacatatggcttatgttacaactgagcaagcccccagcttttatctctgggagctgtgaagttgactgcttataaggtctcaatgtctaattaatccttacttaaaattcacctaagtaagtataacagggataggaagttggtttctgttagcagttccacctttcaccctaccaaacatctgggaaatattcagtttaagatcagatccaagccttttggcattaactaccttaaaacattaagatatcaccagcaatttgcctctgtttcagaaaattaaaagcatatttgagatataaacatgagtgtgtcactaatattactggcaataattgagagctattcttttattataatgaggggaaaacagaggatattctcagatgaaataggtagagtaagtccaaatggtaacattactttcctaaaataactgtgtatgtaatgaatgctgaaggtaaagcatattaaatgctagtgttttctttcatggctgttgcactatttgttaggatagagagcatacatagcttatgtaagcaatataaagcctcatctgtctcttagaaaaatgtcaaaattacaatttaaactgttcaaaatataaactaagaattatcaacttcattgatcagacgtcattttttgtgagattattgactgtttgcttaaaattaaaaaaatggacgttttcttcagactttgtctcacaaacagtaatttgcattcatattcttaataattaatggtgagatcatggggaaaagacatcataagtaatgattcctggtaaaattatgatggttatgacttcatttatatactaaagctaatggtaaaaggagagagagacaaatgagaagtgcttttctgtggtttgaagacatagttctgaaaaatttctttgggagctaaatttaaatttctgacaagcctcttccttttgtccagatacaaattaagccagactagatagtgcttaaaatttttgtgcacttattttaggagctccttttttctggggccactccaccaagactttgcttattacatttttcactttggagctttgcttaacaattcagtctctttcttagaaactgtttgtaaacatctatcagtatccaaattcttacatccataaacttcatgtgattttaggctttattaaataattccattgataataagagaaagaggaaaaggaaactggaaatgtgactgtgcctttaattggagattgcaaaatttttctcaagcaattttcatgtttgattcaatgttttctaaaaaagcattgacatttaaaacattctttaaaaggtcattttaaagacatgtgagcaagttgtactgagggtgttgtatgtgcaattagggttctttcctctgtaaagccttgccaattccttagatgaatgagaatccatcagctcagttttcatcaccttttgtgtctctgagtctgacacaatgttgttgatcccattttgcatgcaaaatacatgtgggattgaaaattaaaagcagttaccagccggctgttaataacacataaccaaagatcatcgagagcagaaatcatgctagcatcatgctaaaaagaatgtctaacagtgccatgaatattgtggttactcaatacttagtgattggttgatatttaatgtggacacttttgggcttgagatggagacatgcaagctgtgttctgatggcagtgcagcagaatataaataacttgaagggaaaaaaaaaacctaccaattcctccctatctccccacctcttcagaaacaacgaatactattaaacccaatagatgtgtaaagcacaagtatgaaccccagttttccatttaaataatacaaagaggtgtttagcatcgtgttaaagtctctctctctctcttaatctttgggtagggattttgttggtagaagttccagctttggattggcaagttggaagctgtatgaatttgaaacagccagttaatgtctaggagtttccttcctcatctgtaaaataagttggttgccccagtgagtatcaaagacttttccagctttataattctatgatctatgaacaagagccaaaatcacaatttaggatttggcacctgattttatactatgctagtgccatggaactgcttatttcattaatctcacatgttgaatttctctatgtaacctggtttgactttgttgttttttcctttaaaggaaccaagcatactatccatttggcaactgagagtggttcttaaaagagcttttaattgggaaataaatgcaatgccagtggtacatatgtcctactgccctctagtggataaaaccatatcttccctagagtagttaacaagtttggttaaaatagcgcttctcaagctatacacatcacctggggtgacgccttagcttctgcattacaaactcccaggtgatttcagtgctgctggtcctaggaccacactttgagtagcatgagtttaagtgattttctttggtatataattactttaagtaaggaaggaaacatatttggcacaggatatgaaagaagtttctagttagcagaagatgcagaggaagaaaaagaaacagaaggaggggaaggaggaggaggagagaaaagggcaagagaatgagaaggagacggggaagaatatgaagaaggaattaaatccaccagattgaaagggctcatgtggcaaaactacatagttcttgatcactagcaatctctagaaagtttctatatctaggcttaataggacagtatatgcattaggacttacattgtgttcctcttatcttttattatattttagtaaattttaattaaaaagaagtcctgaccccccccaaaaaaattacaacttcttgaatcaaagttaagattttacaattctataattatgtaaacatacatattaaaatcagtctagagagaaaatactcactacttttgtgtattttattacagaagtaagctgtgttggtggaacactgagtatatatagctagatgcacttaactcttgcatagtgagatttcttcccagacagtagaatagtcaaagtttagcaacaaaaacctgtatgttcaaagcactgttctgagtactgagaatatagacctaagcaaggaagccaacccagcagtggcattttgtcatgagttaattccagagaagaagagaataaacaactatgttaaagtataacaaaatttatagaagattaatagtcatcccatttatggagcatcactatgtccttgaccctatgctaagcaaacatcggccattattttgatggccccattatattctccattatatacataaggaagctgaaactaaaagaggttaaagtcaaggtccaaactcatgtatgacatcaaaccttaaccactggattgtgttgcatttcattgattttcaaaatgttaactccagctaatcaacagatgaaggggaatccttcccctctgtgttccatattttcaacagctgcctctttagtgcaatggaaggagataatgtgaggctgccagtttgagtaataaataatgtgtgttggtgtctcagcatctcttcatttttattcgatctgtgaggagcgtggctgtaggaagaggcagcgggagggaaagcagaacctgagacttgtatctctgttttaagtttggttccctactctaccccttcagcgtagctttcatcctcttcagtagattaaatcttctggcccacaccctctttattttcagaaacaaatggtcacgtggggcaaaaggtgattctcttttgctgctacaactaggaggggcatcatttccttataataatggtaaatattacttcaaatttaccttcccagttttccacttccaggcaagcatcagttacttgtcttgaaactttgttatgccccatttttttattttgaatgaggatatagtgccctatccttatgtccacaaccttaggccttgtatccgttcctgttttgccatatcatctctgtactccagagtaagaatccattttaaaatactgcttcttctcattctttcatagaatattctaagtttgtttctggaatagtctcaggcattgtctacaaagaaatcttgaaatccaaaaccaacataaaggctctcccaggtcacttaaaaaaagaaatgtaagccaccttcttatcccaactacataggggaatatggttacttcccacagggaaattttttttttattatactttaagttctagggcacatgtgcacaacgttagaagcttaccaatggaaatgtctttagaggtcatattaaagaatgtcagtaatttggattggacacaataaatgtcctaatggttgaatgaattacctagcttaacacaactggtggttaagccagctgaaattcaaactcatgtttttttcaatatcagccaaatgctcttttcactagctctaaaaaaatgatactattgcagagtagttaccacctgatatggtaatgcctagcgaaagctggtgcctgacattgtttagtcagctgacaaataaagatacttgcataaacaagcccaggaaaggctcagtggaaattgatcatgaatgttgggagaaaatcatgagtaagcataagataaatccctgtatcacagaagaacttttccctttctttgtctcccttaatcattctcacttgaacattttcccctactaatgttaggattttaaaaagatataatattgtatttgatttaatttaatcttttccaagtacttccagactcaaaatttaacttcatcatgaaagagtgataaataacagcaagacaggaacatataaatctgaatagtctttttctaatcatcagttataaatgaaatttggttttcaaactaggcttacaggtaggaatatgtggctcataacataacaataatcactcataacaatgatcactcaccaagaggcattcatgcatcttttcttaatggtgagaagaaatgacctactctcccttcccttccctcaagcatgcccaagtagactggagatcttcagattttcctttttgtatcaagttaaactctagtggctgtattttccattctatttatagctagtgttctacttagtatgtatcttagtataaaacaaaaaacatactttcatattaagggtactaaacaaaagttctcttgggaattctactggtaacaatcattcagattttatgttcccaattctatgtgacaaatataatgtttggcatgttaaacatattcattgatttacaacctgagtgttattaagaaaggccaattacattctatttatttaggttaaattattttttagcacatggaagctaattatggaaaacacatcctttgtaccaattcatacaggagtcaagccatgattagagttgcctgtctagctttaatatactgctttccactttattgactatacagattgggaaagtacatattgaaaatgaaagacaatctgtaaacaaatgttatagaatatgctactttacctaggcatacccattttagtaactcatataaacattcatattattgaatatttaaaatatcagaatataattggtaaatattaataacagtaataacttcaacagaggtctaacaaataggacaattctatggattcaaatgtttgaccaactagaaagtaaaagggaagaaaactgaaataagataacataaaatatgtaccatttgaatcacaaatttgtagatgaataaggtagaattgttttatctttatcattgtatattaatgaacttgcatgtttttcatcatattttaaaaccaaattttcatcagtatttcattaatgtttttggagagctgtgctttttataactgctaatttttaagttctttgtaagtttgattctctttctttttttctaattcattttatctctttaatgagagttactcaaaatatataatttttgtctgaaaatgatttaaatagtctaagaaatactggtgtttttcaaaatttctttcatggtatttaaatgcataattttgtgctagtttatatattttattctcgtctttttgtggtttgatttcataatattcagagataatcagtttcaaatacttactgtgatcaaaattactgattgtcagattctatgtttgtcttctttgttttgttgtaatcatatcacttcatttccccacaccctcctcctccggggagaggtggagaagaactgtctcatggaaagatttctctaatgagtaccctaagtgacagaaagaccatatagagcaatgcttatacatttggactttggaaagctggagttcaaatcctgggtccacaaattatttaagcttgctaagcccagttttttcatctgtaatatgaaataaaaatagaatttagaactgtggtaagaattaaatgagatgatgccttaaaagtatatagaagaatgataaaagaatatggtaaaatgacagttacttttattaatctccttgttttgcatatttcagaagtcagcaacttttcatcttagttacgttccatctaaggtgaaatctagatagaggaagtgacatggaagacaaagagcgcttactaaccaatttggggaagtggcaaggcagaatggtaaacctgaaaataaccaaagatgagcctcaaattttcttagatcctatattccctgacagctgactcaaactgagaaagaggctatcttaaataagatagagtaccactatttctgccactactattataacaaattttaatcccaaaaataggctttaacatctagtggtttcacctgtgaatgttattacattttttttctaaaataggtaagcttatgttatattagtgatcccaatttattttgcaaaaaagtagcataactctgatactgaaatattaagataacacaaaaagaaagatactattgaatcctagataaaacattaattaattgaattccacagtctattatagaagatctcattatgatcaattgaggcatatcccaggaattcaaatgaagttcactcttagtaaactacaccgactgacgcaactagtatttaacattaactcactagtccaggttaatgcaatgtaacattaaacaaaaattagaaagataagtattaaaaagaggaaaccataccatcattaccttttgatgatagaactgcctagctaaaacacaaaaataatctactgaaaacatttatttcagtttgttgaattaaaagtactttaaatcaacatttttctatgcgtgaagcactattagaaaataaaatggtcagagatgccaaaaacagatttggacattaaaaagcatattagggcccagcgtggtggctcacgcctgtaatcccagcactttgggaggctgagacaggtggatcacgaggtcaggagatcgagaccatcctggctaacacagtgaaaacccgtctctactaaaaatacaaaaaattagccaggcgtagtggcatgcgcctgtagtcccagctacatgggaggctgacgcaggagaatcacttgaacccgggaggtggaggttgcagtgagttgaattgtgccactgcactccagcctgggcgacacagcgagactctgtctcagaaaaaaaaatgcatattacaattattatgtgtaatgatgacaaagtgaaaacaatctaaatgtccaaataaatgtatgtattaaataaattattattctaacatgtaattattatgtttccaccaacaatcatataacatgttagaaaaaggttaaaaatagcattaatgagttgaggaattgctaataatgtaagctttaaatttgatattttatgctcacaattctataaaagctaccatttaatatattatcttaaataacacatatagtttttacatatctgaaagaaggaagataatctaaaataatgattgcttctgtgtgatgacattattggttatttttattttctttgtactcttctgtattttctacaaccaatatttagtacttgtttttcagagtacaaaattgattttcagaaaatatgacaataatcaaatttgagggataccaaaagaaattatgaagctctgtgtagacctcctggtttagagtccctgcagtgaccggaggtcttctgccatttagaggagataaatgccatatctacattgaaagatgcggcacagatactattcaggttgacaaaagcatccgtccagcatgtttagcttcctaaggctttgatgtgtttaaaagatcagcaaagcttttcccttgtcttccctcatcacaacacaagttcaaagaaacatttattatgaaaaggctaaattctaacaaatgtatctccccagatttgaattacaatttaagtttctctataactttatcagaatttccccaacagctgagttaaagtactctattaattttcattagctgtttgtgattaatttgttctgttttaagtatcaaagtcaaaagaatgagacatgttattgttattgagcgaggaatgtaagaagataacagagaattaatgtagaaaagcaaactgtatctagattgagattgtctaactagctacttagtaatgaatttaaggcatgttaggaacatcagttagaatgtgggtaaatggtcatgtaaagccaaatccatgaatctgatttcctgttcatttaagaccaactatatttaattttaaacagcttctttccttttactattttttctaaaagcgatcaaagcacacaatgaatatgatttaaagagggtattttatgaaaatttccaaaatatctaatctgtctttaaatagagactaaaatccaaacacaaagaacattttaagctttatttaattatttttatttgaagtctttacatctcaggttctaaatgttgtacaaatatgaccagaatagttaaattattttagagttcagtagtaccagtaagtataaactaacccactactcaaaaaatgttacacatattataatttaattggcttttaacttttgaatgtagaaattatgataattgttctcacagtatattaaagacatttagagttgaggacaagagaaaaaccccacaaattaaaaaaacttttagcataaggcgttctgttggggataagagctttctttatataagtgggctttgttctggtatagcaagacaattttccttgcgtatttgcaaattatctaaaatgcaatgataaccttctatcaacactctatttgtgaaacagtaacctatgaggcccatactgagaaatttccacttctttttccactttgcaattctttgaatgatgtcttcttatcttcaaggtttcctctggccatttgacccctatctttaatgtcatgctttctgttctgtgctgttcagctcctcaccttcccacttttggttaaattcttcccttctttcagagtccttattatctcagacaaaggactggcacttcaggctatatgcccccattcttttcatgttcctatcaatgtccatctcttgcatcattcttatacattgctttaaattaaggtagaactttgctcatttctcttgagttgaactttctttctccactatttggttagttaataggacaggaaaacggtaagaaatcaagataatcaagatttatgagaggctgggagtgaagaactttagaaagtagcctcatctttgtcccagtgaccacttgccactactaagccaaagtggccatgaaattttccatttcgcacacatctaccactttggacagttaaggagaaatggagttaaagaagaaaggagtgtataaaaatgacgggagcagatgagactgaaatagcagtggaggggaaaagcaggagttggcatcaacacagaatttgggaggtgaatgaactgaaagtagcccaaagaataggaataacactcctttccctgtcccttcaagaattgcccaaaagttatacactttagtgagggttataagcctttgaaatctacccttgtatccataaagtgccaacattttagcttcttggtgtactttctttagctttttaaaaaagatacagcaccaacctaatagaaaaatattatgagatataataaaattttgaaagttcaatgacattatatgcagcatgaaaagaagtgtttaataataggacacagataaatgtttctttgttgtgatggctacaggtattgtcttttatcagtataattttaattttcattattctgacaatactgacttaaatgattgatagttgttggttttcactttaggacagcagagtgttacttaacatgaaattctgaaagaaaatgcttttgagaatttagactctggtggaataactttcttgatacacagctaacctttttttctaggaatttaaaatctaccgcctttggtaaactcagaaatgttgagaagaaaagagaattaggaatgtatgtgttgtcctttgctcaaaagaaaaaaaaaaaagaaaaaagaattgacagtcaaagaaagaatcaatccaaggtggaaggggagagacaaaacaaaagaaagaaagaaagaaaaaccatgtccatgtataaaccttagaaattaacatgagaaccacccccaagttaaggattggtttacatgatgacttgaaatatactttccatttaatatgagaaaaatatattctaatcaagtcttcctttgttcttattttttagcatttctagagtctatctgatttctcagttctagcgtaaaagtttgcatatgagttctaggtgaaataaatggcagtaaatgcttgttaatctaataactattatagcataatgttttacaatggaaaacattatgcttgcttctttcctacagatattatgcagattcattgaacatgtctttttgaaaatgtggtatacataaggaatgctgcattggataaaaattggtaaaatttcacttgtagggaatacttaggagcaagaatgtaaaaaaactacaccactccgttatacttcattaggtcatgtatctggtttactgaatacaatgaagaagaaatatgatatggtttattattttatatattcagatagataatagatagtctgagctatttccataattcactgccttgttattaaaaaaaaaacataaacctgatgagtgttttcaagtaggtaagttattttagtctattctttgaagcagagcaatgaaagctctataatgtccacataatagaccaacttactgtaatgtaataatcttggaggagatttaacacccattatctgaagacctaaaacctctagggaactgttatggttgctcagcactgctataggacctaaatgtaagaacagaaacatttctgaataagatccaaagtgactggggagaaatcatgggacagtgggttcatcatggaatttaaaatcagacagagctgaaccaggtctgccttatactcttttgattgatattgaacaaccctacttcatagaatttatgtaagtaatacattatttaaggtatggaaagtattcaacaaatagtggttattttatttctaaattccaactaatcttgtatgctttgcagaaataccatttggtgatgattgaaggtagagaggggaaagcaatattgtcttttctataatattctttaaaaagagtgtatgcatatcttgataacctcactctagcaataacatttgtgaatttaaaactatctggaagttagtaaatttttattctcagtccatgctaccacgtattccttaattagctgtctcctttataaaattatattattttagtcttaaatttgatcttcatgagtatcacaaacaaatcaatgcacacttatgaagtagcccttatgtattattaactataggatacaaagaagtagaagtcacactccagcatctagaccttacttttacttcagtcattgaaattcagtgtacattgtgttaggcacattctgtcaaaggacaaaacaatttgtgaaagttaataaatattagatatagatgtcacaaattcttttataacatataagtttctgaataaattgtatcaaaaataacttcaattggagttcaagggaacaaggattttggattaagaaatttatagaaagttttaggaaaaaaaaaaaaactaaccagaattcatttttcaaagtgctgtgtttactgattgccacgtataggttaagcactctagtaaaccacaggcaggaggaagacagagtacccttacataaagggaatgaaaatatttaggaagttcgttaccttgcccacactaaagttcatctacattaaaaaaaataagttgcttgctttgagatatttcagtaatttaagttggagaatgttgccgtctaaaggaaatccatgatgtctccaaatttggggatgtcagtctctctgttttacatgagtaaacagaatctagaacagtaagccaattctagcggagtaaagtgagtctctagattttattgcattgtctactagctccaaagcattaatcctcttccccaaatgcatcacatagtttggtaggatctcattagttatataataatttcctcaccattccatcaaagttccgaacttcaggaaagaagcatttccagagatgggtgcagattcaaatagaggtgggtgggtgtgtgttgcccttacatgaacaaataaaaataactcgtctagagtttatagttcatgacaggcattttgtttacaaaaataatttttcatttaaaagctctacttaaaaaatttttttgaatttaaatttccactttatgtacaagttaggtacaagtacttattccccactgaaatctatgctatgaatcctaaagtcttatcaaatgacaagaaaacaaagaatcattacaatcataacttatcttggatcccttaagtctaaagatccttaaagcctattgctaatattatagctcaaccataggaaatacgactgaagatcatgcattacctgattgtattatccagttttattcatgtttagcacaaactctctgatagctaattttacattaaaattctgtcttctaaaatgtgggacacataacattctagatgtttcatgctatgttgagggtatatgagatgcttctgaggtggcacatacaagtagtatgaaataacattaaatcataaaatgaaacacttcctgtttttcagttcttctggttatgtcaaggaaaatctcagtttattactaatatgtccttaacacctctggaaaacttgcttatctccctttccaacaaatgaaatctgaggcctcagacttagattcttttgccaaaacatagcatatagccacaatttaaccatggtatcttgtttttattatatttaattatgtgatcaccttctatttatggcaacagatattggctttccctttattagagtgatataataatttgtctttaaaaatacattaattttagtatacaaagtgagtcaatttgcaggaaaagaattaaggaaataataggatagggcctgacaaatatggcaacatttgtagtagtggtatgtgaatgactggtgttgagaaaatactgctaatgatggtttaacaacccaggaaagtaaaagctcttgctgaatgcagacagatcaaagcacaactctgattaaagaactagaggtgaacaaatgtgaatccagacataggggccaacagaacaagccaggttggatggccagagatctggtcagagtgcaagcaaagagacgtccatagagaacagagagacaggtgagactgaaaacacagaaaagctgtcagctccaagtctgaggcaagctgctagtccagcccaagtactttaatgcatcccattgccacagtccaattttatggattcatgcttgaatggggataaattcaggcagatgataataccatgtctgaataaagacaaactgttaggaaaatagcattttaagcaattgtatttgttactagggtactataaaaaccacaagatgtgtcatttgaaagttgttaaaaagattaaatgaatttttttattacaaaatttcaaacaaacagtaaaaatatcagatttgagatgagttatagttggggcaaaagttaaccttttttttttcctttaccaaaattagggttttactgttttgttttctctgtgtgtgtgtgtgtgtgtgtgtgtgtgtgtgtgttaaaccaactctctgacccacttctgcttccagggtcaaatattttgcatttccaatactcaggattgagagagtacaagttttccttcatgatgattttctgtggaacatttgctaataataactaagtttcagcattgttatgattttatagtatgtactgggtcagtggtttctaggggtcagtaaaagaaaggaagttttggaactttcaaaggatttcatttgaaaaaataacttttcgaatttggataatagcacttgtatattccttgtagtttccctgattcaaggcaataagcagtatatacaattacttgttagctcccttcttttcatgttgatagggaccacccatctgtggccttgggtgcctaaaaaactttagttattacaatcgagagtcacattagagattgtctgtaacttaaatcagcatatattatgtatatacactattttcaaatatatttggatatttttagtgacaaaataataaaatttattttaaagcatccacactagcttttcatcataatgtaggtataatgaccccatgtgggagtctgcaaaatatcttgaccttaaaaatagtcttcaaattccaaaacaaacaatatactgctggaaaataatgaatatagaatgagaaaatgggaagacttgatttgaagataccttgaggaaaaaaatcagtaaaataaaactgaacaaatagaatttaaccaagaatataatacttcagctaggttttatattttctgtttacaagactattaatgcattacaattttccattattattgaacttccattcatcttaaccaaagtgaatgaccattaccatcatcaatatctgacaatgtacaggatcattctctgcaacatgcttggggatctcttcacaaaaacaaccttattttgacctcaagctttcctcaaaatttctctccttttttttctttgcttcccttctcagaaatagaaagtttttccccattgtttcactgttcattccctttctcagctcaaaaaaaaaaaaaaaaaatcgaacttctacttgcctttcatcaggcaccaacaatgctgctcaatttcaactgtcttttctcatcttacccctccttgcatggcattcaacatagctgaccttctatacttggaaagttttctcatccatcttctgagatatcactctcttgatttttctcccatccctttagtacttctaagtcatttttctgttttcttctcttgctctactcagtatgaaaatattgggttgacgttggactcaggcctaagtgttctatgctgcctccacaggcacttctgtttcatgactttaaattcaatacatatgttgatgatgcccaaacatacatctccagccttgacctattctctaacctcataaacctctaatcacttaacggctgcccttgaaattctaatagtgatcttatctccaaaattaactgatttgtcctcctgaagctgttccttgtcccacagccttaatctcagcacaaaacaacaccacttactcttttcctcttatctatgtacctcccacccccatttacagtcaaacatgaacacttacttgttctgcctccaaaatgtcttgactctttcacttctctacagctccactgtcagtgctatccaaaaccatcatttttttctcatttgtatatttccttcatttttcccagtccccaaaataaagtgaattaaaaaaaacaaatataaaattatatcatgtttttcacttacatcaatccattcactagcttcccaaattaacatgtcaattaattttggagataacatcactacttagttagaataaatgtcagattttctagcatggcctacatgaccaggatctactttccaaacttctcccactactctctacttcacacaacattctccagcccacttggccttctttctttttcacacattgatttcattcttcagaactcatgcactctgcctgagctttatttccttgatttttgtatagcttactctacactttgtcattcaggtctcagtacatcgcctcataagtaaataatctgatacaaataatcggtctcaaagtagctccatcttgaactttttgcaataatagaaatgtttgataacttatgctatccaatatgtgagtgttgagcatttaaaatatgactaataatattgagaaacagaataattttatttagttttcttttactgtgtcaactaatttaaattaaaatagctatgcttggctagtgactactgaattgaataatgcagttctagcacagcatcttattttgtttcttaaaaaataaaattataaattataaatttcaaaaaatgaattaatatgcttttgaaaaatttatttctgttctctacagcataatcaccatgagggtggggatgtctttgttggtttgctttcatataatcagtacctagaggaaggccaagaacatagtaaatactcaataaatatttgtagaaaaaaatagataattgaatgaatggatgaatctatccctcatgaagttaagcatgagtcataatatctccctttcagactagtataactgcgtcctccctatgcttcctgggatgactcctgcctcactcgactctctccttcacgtcactgtcaaaagtgatcactctgagttacatatgggatcaagtcacactctcctgcctaaaacactttggtttttatgtcaccatcatgaagaaatgcgagcaaccctttataatatggtaacttttgcctagtctggctctgcccacctcatattttactcaagcaatattgatgtacttgccatttttcacacatcttagggcagtatgaatagaacttctttttgtttagcaaaactatatccatccttcaaaaactctgagggctgttctttgtgatgcttcgtccctggcaaatctttcttctcttgctaagaatcactcttttttggggggcaccttttatactttgcccaaatattgattgccacatgaataaatcatacaggacagcatggactgacctactttgcaattttagcacagagcaaaaggtctagctatagcacaaaataagtgctcaatcaatacttgctaattaaactcatctcatgcccttatagtaggattccattgtgctggtggaggggacccaatggctctgtctcaaggtttttattgttcctatagaaaaactattattttcttttttaccatttgtcttatatagaacaactgtttttagtgtctataatatgattttctttatgttgggaacatgctatatttttatttaatttagaaggtcagtataggagtcttacacacaatccctctggaatatgtcttttcctaagactgccacgatttgctataaaatgtaaatagaatgtgtctgggcaaaaatgtttgacaatatgtggatggttaacagaagctcctgaggattctacctgccatctctctataccatgaatgaagtagttaataaggcacaagtagacttgcaacttttttttaaaagaaatgtctcatatgttctgaaaagttgtgcatataaaggtgggttaacagtgagttattaaaaatataatttgcttttgtgaaaccactggcaatagtaggatgaaatattccataagtattaaacaaagttaacactaataaaacttactaatgggatagtcttgccatacttccttgccatagtaacacaacttactaatggagtagtctcacctagttctgaaaacagaactagggacagaagaaagggcacttaacatgggatctggattttataatcattttgacactaattgtgcatatttgtgttcaccagaccttctgagttgtaaagaaagttcagtgcaagtttctatcactcccatcccagataaggtggaacttccagccttcccattatctctagaggttcttaggagcaggttcctagacttagcaaataaaaatacagaattcccaattaaatttgaatttaagatatataacgaatggctttttattttaagtgtatttatattacatgcaatattttggacatatttataaaaagaatctgttatttatctgaagtccatatttaattggaagccatttaatagaaatccatatttaatttttatctggcagctctacatggggagaattctgggaagtggtgacttatgtttcccctcatcacctctgattctaaattctggcttaccctaaatgctcaatcttatgtgtccactacaattctgatttcattttctatgactcttcttccttatgctctgcactagttgcatggtgaaccagggtttctcttctttaatgtttccttccaaaactcgttcaagaaatttatgaacacagcagactttgcttaacatttgcagctaaaaagagactatagatctgtccagcttaaataatttaagattaaattaaagttgtgtttattttctaggatactttggttacattctctgcccctctcccactttctactttgagcaaatttctcataggcacttgtctctataatcttttgcctcattctgttttgtttcacctcctatttcttcagccatctcatctgtcttgctgcttaccccagcagccagataattattaaattcatatggaaagcaatttagctatcttttttttaccaccactttacaaattaaggtctttgtggtcttaatacttttaacaatgataattcttgcctaagaaaatgggaaagcattttctttatatatatatatatatatatatatatatatatatatatatatatatcagaatatatatatatatcagaatatatatatatgtgtgtgtgtatatatctctatatatgccattttatttgctctgctaggctttagtctcttattttgaaatcactaagttagatatggccaaagtgtacatgacatatcagtttgactcatacttcattttgaaaatagcttgatattctacttttgctaaggctaaatatattcatagaaaactaaaaaaactctttgggaatatctatcaataacttaaaaattttgaatactcttagacctaaacagttggcttctagacaagtatttgaaagtaataaagttgagtagttaaggtcatagtctttggattcctacagacctgggttcaaatcctagttttgccatctaaagttatgaaaagtctaagtctcatttgtttagtagtttgttatttggatgtactgtattgaatcatgtgagtgtctatttttctagaatatatttggaaaagtatactcaatagtgtatggctcagtgtaataatttatgacaaaagatgaacaacaggttcattccttttttaaaattaaacaaacacacacacacacgcacacacacatacacatctagagttgaaattgtccacgtcaaaaactgagataataagaatatcaaacaggattattgtgaatattttaactattgatatgtatctcttctaaatatatataataaatgtatattatctattatatacataaatggttaagtaaactaagatataactagaagtcagaatataagaatcttaaactaatacatatgaatattttaatgatatgaaaaagtatccatgagaaaagcctaaacccaggataaaatgtactgtatacagtatgatgtctcctcagattatccatttaatgtgtaattatataatcatagatacagggaaaaaaataaaaagaaattcaccaaaatagaacaacaggtacttctaggtagtagaattatgagtagctattttaatacctctttatctacatatttctaacaatgggcatgcaatactattagcaataaaaaagtaatgtttacatgtataaacatatgtatgcataacatatacatacatacaacacataggtgtgtgtatatatataatatacatatatgtccttaagttttatatattattgctgtgtattattttaaagaaatgtatccaatttaaaatgatgtatcaaatttttttaaataaaaatgttttattctatccatcattcatttcatgaaaaaaaaaatcagtatctaggtttagcaaagagattattaaattactatggctcattcttggttttgttccatgtattagatagcactttggttatttctttaaaagaatgtgattttggtaacttccaggttgaaagtttccaagttcagaaaacttgtttttatttgtatcatttggtagcttagtaaataatgcccgctgataattattatatttcacatggctaagaattttaaaagtacttaaagtaggtaaatatctattaattaaaattaaccttcttgggtaagactgcttactctggcattgttaaatgaagaaaagtgagctaattaagtttagcccgcattaaaatttgaattttattgtgtctaaaaatactcttattctcttatcctttttctttaggaagaagatgctaatctatggcagaatttcttatttatctcattcaaaatacactaatcagatacaaaagacatgctttaaacacatgacagtatgtgtcaattttcttatataaataagtggtttgatttctcacccaacaataaacagataataagatagatagacacataattggcaaaatgagtcagcagttcattctcatatttttgataattagagattatattgagatgtcctatatcaataacagatgtcaccttctctgatttatcccatttgatagaatctttttttaacagttcagtggttttccaaagatttaaaaatagaaatatctctgacgatttgagaactataagtaaaactaaagttaaatgttagatcaaaaataccgtttaattaaacaaagaaacatgctactctgtaaacttttcctctgaaaaccagaaatcaatgctttccaagtcagtcccatcgttggaatcttatctgtaaggaagaagacttccagattacctgtgactactttctatactaacatttctattaatattttactaccattattagtttgaaccctatgaatttccattcttgcaggataaatttggagagatggagtcaatagtttatgattcagtgtaataatttttgccaaaagataaacaacagttacattccttttttaaattacacacacacgtgcacacacatctagagttaaatatttactgatttatatcttgatttttacgtttaaggtctggattttccaagtgtgaaattctaatactactaatactactactactaattttaatactactaactcagtagtaaaagaaactaataaatatttatagaatcaatcagttatgccattatcagtgattccatctcagactaagtagggccaaaaattaattagaagcatagtccatgaaagaggagcacatttggggatgcactgcatgggtgaccatcattcagcactgggcacaacattgggactgataaagataacgccatgccacttacaccgttagcagggtgaggatttgagggactttcgatgcaattctttgattgaaatcttgtgctctgacagtagatttcaatggtttagtcaaagagttgcttgtacacaatgcaaaagctgccacagagggaactcatgcctggcccttcatacctctaaaaggggacaccaatacagaggtagcatgacccttaccagggccagggtacaagcctagctcttacattttaggaacaaaatatccactgtgcatttcgggaactccacctgactcctactcagctgctgacataactctgattgagacagctaatttttgagatcaacagtctaaagctcaaaaacatctatgaaagtatcttaaaacccacccctgtgctagtttagattggcaggagtacatgatttggacattctcctggggaaatgtctaagttctataattatgtttacccaggcttcttatgctgagaaaacattttccaggtacatttgattctaccaagagaacctttcaatttagaagatacctgagaagctctcattacggtatttgaaagtgctcccaggattccctctgtgactctttttcctcatcaataaaatattatttgtacctaacagaaggatttttctgagatttgaacgagttaattataatatgtcctcaataaatgctaacagaagttgtttttgacactattaaaaataaaaactttcagtcttcctaatattatatgctaggcttctcacaagaattgttgagatacgttcttagagaaaatgttttgtaatttaaaaaagatttcttagtatgacacaatgccatctgtaggtgcaatgaaaccaaatagtctctgtgttctcatttttattacagagacgcaactgatttcatagcgatcttatgatgattatgaatgagattatgcaggtaaatttcctagaacagtgtcttgtgaacactttcttcttagttaat

SEQ ID NO: 24 - DNA, 63431 bp, Homo sapiens
cttgaagtcctaaaatttcgttgggaaatagataaattatcttgttgagaaggagaggccataagtggtgtttgaatagaaagctgtactgttgaagattttaaatggctcttgtaggtaacaggagaaagagcaagcaactgtgggagcagctcaagttggagaccataaaattaatattggcataaatctgtggggcattgatttcttctagacatttttatccaaatacaggaaataaagatagatagttgaaatgttccaagggttgtaaggaacattttagcataatcaaggcaatgaaatgaaagaactttagagacactggagagaatggacaaaataataattgaattaaagaacctcggagcctacactagaaatgaaaataaaagtgtataaaggaggttatttgatggatgggtgtcaccatatatttggaggatatgtgtggtggaagtaaaggaagaaaggagttgaggaagaaaggagttgaaaagatagattttagttataaataaatatataggagttgaagatttaagaggtggggcagttccaagtgataagaggatctttgtatgtgtctatggaaatcagtttattaacgtccggtaggataaagattgttggtgtccaaaaatgttgatattaggtaattgggagggctgttcttatgaatttggaagttaacaatgattatggcagaaattggatggagagaaaaagcttcataagtcaaaatgatgtaaagaccacagtaaatgaagatggtagtatgggaggtcaattgatgaccaaataaggacaagttgaagatgatgtaattgaaaaaccactttattttctagctcttccatgctaagtgataccctacttcaaaatggacaccctgctctcctggcttgaacagtatcatcactttctcagagtacagacatgaatatcttagaaaaacccctgactagcttttatctgatacatagattctttcatttcaaagtctatctttaattaatgcttaaatactcctgtgggtattttattaactttctaaattagagctttatggttccccttttttcttttactctttctcattccacatagcaggattagggagctacattctcaataatgacttcactagttatggaaatttatcagaatgcttttaggtcaagagaataaagaatcatcagcggaaaaagtatcagaattgaaaaatttcagaagtctccagttagatttcactttttgatcacatcttctttctgtatattgatacctaatctttatttgaaaatatttagagtaaaactcaaagatgcctactggaacatactactcgcataaccaaaacattgccctattcttatgtgctctgcaggttaatacttttgcagtagcttatgagagaagataattcagttaacatatattaggatgcttgtttgagtctgtattctttaaaaattaattatggccagatattcattttactgtgaaaaaactaagctgattaaattagattgatttgcactagatttgtatttcaatacatactagctttcattttcttttccaaaatacttttttaaattaaaataagttataggaaatatttccaaagcacacacagacacacacacacacacacacacacacacaccacaaagtgtacactaaagaaaatgattttaaatatggagggggaaataaatagtatttttcatacgtaataaagtattacataaaacacatcagtaaatagcttaaattgcttataagtaggaaaaggcaaatgcttttttttatttaaaacttctttctagcacaggcttttaaaaacaatgttgtttaaaaatttaaataaaataagcagttctgaagatctctaaatgtttctatacaagccttaaatatgtatgtacataatttggccatttgaaatagcactaggataaaactgtggctgaccagtttcaatctaatatcagagaaaaaatgtgtgaaagactttgaaagggtaaaataaaattactaggagtcctggctagtacacccttcagaactatctgtgcctttcaatctccgtgaacaattttacaactctaaattaagaaaaactgtgagcaatacaaatgattcttctttatagagatataaataattgtgttcagctaagttacgtttgattattgcccagtgaatattgactagttttgcacctatctgtgaatttagttcagcatttttgattgccaatatcaatatagacatagaagtagacatagacatagacatagatataatatatagatagataaatgttctttgaattctcataactgatttattctttaatgagttaaatgatatctttggcatgtgctcattttatatttatatgggtcatggttttatgttcttaaaaatgttccttggcaattaataaaatttaaattgactagctgtaagttaaaatattttgagtcaacaaagctcctactttaccaaatttggtttaaaactttaaaaccttcaccataaaacaatttctatttttgcaattctttgagaaagttttgtccaaagtgtgccctaagaattattttctgagatatttcttgaaaggaaagttttatggtaaaatacatgtgtaaaatgcaatatatctttctggtaggaatcctaatggtctttactgcacaactgtctactgagacttagaggctctttttaatcaagttgatgtttctcaagcaattgcactgtcaactactcttcataaactttctgctataggtacaggaatattcacgatctccttgatctcccctagctttacctattttgaactttccaactttgcttatcctcttctccttgcctcacctctctactataatggtctcctctcacctctctgcttttccaatgtgaatcaacaattgtacttctcctactactattttttgtaacaattgaaatgtatgcttatgtttgccactggactgtgagttcttagaggatcaagaatatcttattcatctttgtatggcagggcaagggagaatttaagtgaagtaacactctggtttagttaaggcttctctttgaaggttttgattttggagtagcaaaaaatgctgcccccaaatatggcacattggcacactatgtattttaagctgaaggaaactgagaaacttgcagaagcagaaagattgctctcaacttccgcctcctgtcttttaaacactgtgacaagtgccatgctttaaaccatgagggaaggaatattatatagaaaggccaagaagaatctgaacaaacaggccttgcttggtacccctcatccccagtttattaccattaggtcatacccttttctttttgttccaatcatacttctacaaaattgtctattcttcatcaaatctaagcataaaaatagttgtccctgggtcttcattttagaaagcttctaggtcacataacattttgatgaaataaatttgttatgcctttttcttgctaatctgtctttattatagaagtgtcagccataaacccattaatgtacccgaaattttaattgtctattcgtaatgtttgtgttattgctggtattattatgtaactctgttaatctcattgctttttgccatatttcccacctcaattttcagtttcttgggccaaatgatctttacatgactacatcacctgtaagagaactcttcaagagctagaaatgaattactacttgaattatttgaattgaaggtaggtactacttagtagaagcaccaatgatcacagaggggcagaaaaaaatgtgcagggcaaatttactgccatgaattaagcacttgtactaagaagtttacttagtctaatgattagtgaagctactttcgtaacttggttaattacatttttactctatgtttaatattattctgattatcttcattgtaaaagcatttagaaaaaatatacattgcttcttattctaaatgacttaagtacaaatatgtaaaaagcactctcttctcagtggttgttatatgacttaaatgagtttatatacaacctttactaattgaggttctcgcctattttcctcaagaaatgtgtgttgaataaatttgttaactaggtactatactgggcattgaaatagaaagatggagtgaataatacaaagacttgattattttcttgagggggtggggccaaaatggctgactagaagcagcagtgattggaggctgtcatcaaaaagaaccataactgcctccaaatcctgcactggcaactgaggtatgcagggtcttcatcaaaactgactagggccaggtgaggtgactcacacctgtaatcccagcaatttgggaggctgagggggacggatcacctgaggtcaggagctggagaccagtctggccaacgtggtgaaaccttgtctctactaaaaatacaaaaaacggcttggtgtggtggcggacgcttgtaatcccatactcaggaggctgaggcaggagaatcatttgggaggtgaagggtgcagtgagccaagatcatgccattgcactccagcttgggcaacaagagtgaaactgtgtctcaaaacaaaacaaaacaaaaaacaaacaaacaacaacaacaacaaaaaacaagaactgactaggcagctggtatgacccatggagaggaaggaagagcagtgtgctgtggtggcccacctaagagccacacggggcaggggagcccccacaccccagtcaagggaggtggtgagtgtgctacccagcctaggaaaccgtgctttttccatggaactgtgcaacccaaggattggaggatcccactcatgaacccatgccaccgggaagccatgcagattctcaacagccactcaactagaatctgcttaagactcccaggggaggggcaaccagcaccacagctgccgctgcctaatgtctaagctgcctgaggtccttaggggagaggcaccagccaacactgagactgatagctgcctaacacattaagctcccagggcgggtatggggcagcagccatctctatagctccaggatatgcttttcccctgatggagccagggagtctggatagcttcgtcccaagaggtatcccccacagcccaacacaccggctgtggcagactgcagccagaatgcctcttcaggcctgaacctgacccatccctcctcactgggtggggtctccctgcaggaactccaacaactccagccaggggctcagggacagaagcctgatctccctgggcctgagcccccagggtgaggggtggccacagtctctgcagaccagcagacttaacctttcctcctgctagttctgaggaatctgggcagcccagacaagtgggtttcccccccagcaaaacacacctttcaccaagggatggtcaaagtgcttcgctaaacaggtcctgctccctgtgccactcaactgggtgagactcttaaacagggattgtcagacaccctatacatgagcattcctactgagatcaggtaggtgcctctcgaggtcagagatcccaaaagaagaagcaggcactcatctctgctgttctccaacctcctcaagtgacatctccaggcacaggagtgaaccagatgaatagtgcttgaagcgaacctctggcaaacctcagcagccctacagaagagggacttgaccattgaaataaaaacaatcaaacagaaaacaacaacaatagcatcagcaaaaaagagttcccaactaaagccctatccaagggtgagcagcctcaaacatcaaaactagacatattcatgaagatgagaacgaatcaatgaaaaaatgctgcaaaaccaaaaggccagagttcctcctctcctccaaatgatcataatgcctctccagcaagggtgcagaactggacagaggatgagatgggtggattgacagaagtaggcttcagaaggtgggtaataataaacgccactaagctaaagaagcatgtgctaaagttcttagcaaagaaggtaagaaccttgataaaaagttagagaaggtgctaactagaataaccagtttagagaggaacataaatgccctgatggagctaaaaacataggacgagaacttagtgaagcatacacaagtatcaacaggtgaatcgaccaagtagaagaaacgatatcagagtttgaagactaccttgctgaaataagtcatgaagacaggattagagaaaacagaatgaaaggaatgaacaaaatctctgagaaatatgggactatgtaaaaaaaaatgaacctatgactgactggagtacctgaaggagatggggagaagggaatcaagctggaaaacacatgtcaggatactatctagaagaacttcccaaacctagcaagaaaagccaacattcaaattcaggaaatacagagaacaccactaagatactccatgagaagatcaaccccaagacacatatgggcagccagagagaaaggccaagtaatctacaaagggaagcacatcagactaacagtggacctctcagcagaaactctacaagccagaagagagtggggaccaatattcatcattcttaaagaaaagaattttcaacacagaatttcatattcagccaaactaagcttcataagtgaaggagaaataaaatcctttccagacaagcaaatgctgagggatttcatcaccaccaggcctgccttgcaagagctcctgaaggaagcactaaacatggaaaggaaaaaccggtaccagccactgcaaaaacacaccaaaatataatgaccaatgacactatgaagaaactgtaccaactagtgtgcaaaataaccagatagcatcatgatgacaggatcaaattcacacataaaaatattaacctaaagtgtaaatgggctaaatgccccaattaaaagacacagactggcaaatagtataaagagccaagacccatcagtgtgctgtgttcaggagacccatctcacgtgcagacacacataggctcaaaataaaggaatggaggaacatttaccaagcaaatggaaaggaaaaaagaaaaacaagcaagggttgcaatcctagtctctgacaaaacagactttaaaccaacaaaaatcagaaagacaaagaagggcattacataatggtaaagagatcaatgcaacaagaagagctaactatcctaaatatatacgcacccaatacagcagcacctggatccataaaacaagttcttagagacctacaaagagacatagtctcccacacaataatagtgggagactttaataccccactgtcaatattagaccgattaatgagacataaaattaacaaggatattcaggactttaacacagctctggatcaagtggacctaatagacatctacagaattctctacaccaaatcaacagaatatacattcttctcagtgccacatggcacttattctaaaattgaccacataattggaagtaaaaccatcctcagcaaatgcaaaagaactgaaatcatagcaaacagtctctcacaccacagtgcaatcaaagtagagctcaggattaagacactcactcaaaaccacacaattacatggaaattgaacaacatgctcctgaatgactcctgagtaactaatgaaattaaggcagaaatcagtgttatttgaaaccagtgagaacaaagacacaacataccagaatttctgggacacagctaaagcagtattaagagggaaatttatagcactaaatacctacattggaaagctggagaaagatcacaaaatgacaccctaacatcagaattaaaagagctagaggccggacacgttggctcatgccaactgaggttgatagcactggtcaagaggctgatgatgatgccatttgtgataataagaacaactcataactaagaggtagataggttttgttgcacaggtggagagatggggaaagacagagttattttattgccttatctttggtaatatattagtatattatttgttctttgttttaatttttcaaagtagaatgtactatgttacaaacagcatactaattattaggtcttaaaatttagcatgcaatattcacatgtaattgactttaatgcctctgttatatctaaattgtacctacctaacttttttcatttctttaagtaaattctttctatatttttctgcttttagtttttgcttaacaatcaggcttttctcttttaggacagcctcattcttctccagtctgtcaattttaagtagtcctctggtcaaaagagtgcgctcattatttaagttttgaactaataaacgctctgaagccttttgggatttttcttttagaaacagagcttttctctctctagctttttcaaggtagttgaatctgttttgccaaacttgtcgtaaactgttctgaattgtctctttattttcttcaattagtttttgtgtagcatattttttctgattcaaatgttcattaacagctactctaactctttctcgagcaacttgtgccatggctacaactcttactttttctttatggtattcctgcttcttttgttctgtgtaatatttgtcaatatcactaaatgttcggagtttcataccagctctttgtggtgcaaaaaactctttcatactccgctccaatcgtatgtcttttttaatgattggctttggatgagtagtatagattggctgaggatatgcaggaaaaaaatgttgttttttctctctcaatactgcattattcttcaatgaacctgaagtgtatatgggtagtttgaaaactgatatcctaaaactggtatccaatttttcatccacaatttcatcttcagactcctgacctacatcaaacagaagcaaatattatacattatacaagagctaagtacattttattttctctccaaatatatcaataaacttgataagaaccttttatttactttactaagaagaatttttcccaagtaccttttcaacttgtgatttaatagtaactttggagaagaaaatcactattaaaacattttcacatagaaatgcactgaatctaattcttatattttctgtattatcttccacaattacttaacttgcagtgactcaatagcagcaacttatcacatacttagtactacttaaccacacatattattttttcatatagtttgctaaaagaaacaaagtttaattaagcaaagaataattcatgaactgggtagcactgagaaccagtgaaaatttagaaaactctgcgtaataaatgagcagggagtatttatagatagaaaatggaagaaatatagaaacagcttgattggttatggttcaattttgccttatttggacataatcatatcagttggtggcctgtgattggctgaagcttgactgctgtgattggctatgacttagttatcttttacaaaaatatacctgtaagttaggctttcagtttgtttacatactaagttaggttgcaattcattatgtaaggactcaaggaacagaggcagccttaggccacatttaacaagttattagtatgtcatatttgcaaagggcattgtaatccattttaccttatttttcttaactctggtggaaaatagtagcagccatcaatcgtttttcccttttttggacagacaaaattactaaaactcttagcttcctttgctttcctttgtgtgaccatgggctaagtcctttttaatagagtgtgaacacaattgttatgtgttattccttgtccaagagattgttttaagaaacaatgtgcaccttctttccactacgtagagatgagaatgaaaccccaaaagatggtggaaccataagatagaagctgcctgcctgcctgaatcacttgttgaaaaaacttctcatggaccagaatcatccaagttgggtcatttatgaagccagaaatcaaaagtaattatgtttcagtcaatatgcatttctgggtctatttgttactatacccaacctaattaatacaataaattgaatcacattgttgtttgcatatttactttttgacaaacctactaatgaattcagaatcaggtgacaaatacaagtataaaagttatgcttgttaatttaggagaaaaaggtgtttcttgatttcttccacttattaaaattacattcctgctaactctagtctacaagggtttgatcttccttagaaaattaccttgtctttatgtgtaaaaatgtcaaatatgatgctggtggttttatggaagttaagtgaactatgaagaagggcagggcttgtagtctagacggacagtagaaaataattgaataggcaagattttcacgaaaggctacaggagtatcaacgttggaaaagtaagtaaattctacagcaaagtaggaaatcaagtctagcaaatagaaaaggcagtccatcaggatagaaagccaaagtgtccagaaataaacactaaatatgtgtgtccaaagcaagagactgaggagccaaagtgtcaaaagtcagagtctctcattagttggttgaacatagtcccattaacacttttaaaagtctcctaatttctttctctgttttcagaatctctgtttcaagaaatcactcactgctatatttatctttcttaagtagggttctaacaacattgtaccttatacacaaacaaaggaagacaaaatctttatggctttccacccatagtctgaagaatagtttccatttttggcctaggattatataataccagaaaagagcgacatatttttccccaacatatgcatcatatcttatcatcattgggcctttgcttctattattttaagttttgctcagtatgctgtttttcttatctgtatctgttcatattctatgcattcttccatgtcttttcacgtcatattttccttattgcttaaaaaagaattcatatgttttaaactatcacatatgtttttcctgatagaattaatcatattccacttacattaaagctctatgtagtagtttttagctataggatcgaacttgatataaccttcttatgagtaaggatctactcctttggtctttgatgctacattcccagcccctagcctactattttgcacagtttggtttgtgcagcaatgtagtttagatgtgtgtcccctccaaatcccatgttgaaatgcaatccccaatgttggatattgggcctagtgagaggtgtttgggacatggggtagacccctcatgagtggcttggtgccctctcgtgataatgagagagttcctgttatggtagttcatatgagagctagttgtttaaaaaagtctggcacctctgtcttcatgtgatatgccagctcccacatcaccttctgccataatattaagggaaatttatagctctaaatgcccacaggagaaagcaaaaagatctaaaatttacaccctaatatcacaattaaaagaactagagaagaaagagcaaacaaattcaaaagctagcagaagacaagaaataactaagatcaaagcagaactgaaggagacagagtcacaaaaaacccttcaaaaaatcaatgaatccaggagctggatttttgaaaacatcaacaaaatagaccactagccagactaataagaataaaagagaggagaatcaaatagatgcaatcaaaaatgataaaggggatatcaccaccgattccacagaaaatacaaactaccatcagagaatacgataaacacctctatgcaaataaactagaaaatctagaaggaatggataaattcctggacactacactcttccaagactaaaccatgaagaatttgaatccctgaatagaccaataactagttctgaaattgaggcagtaattaatagcctaccaaccaaaaaaagtccaggaccagagggattcacagccgaattctactagaggtactaagaggagctggtaccattccttctgaaactatttcaaacaagagaaaaagagcgaatcctccttaactcattttatggggcaagcatcatcctgataccaagacctggcacagacacaacaaaaaaagaaaatttcaggccactatccctgatgaacattgatccgaaaatcctcaataaaatactggcgaactgaatccagcagcacatcaaaaagcttatccaccactatcaagtcagcttcatccttgagatgcaagccttgttcaacatatgcaaatcaataaacataatctagcacataaacggaaccagtgataaaagccacatgattatctcaatagttgcagaaaaggccttcgacaaaattcagcaggcttcatgctaaaaatgttcaatatactaggcattgatggaacgtatctcaaaataataagagctatttatgacaaacccacagccaacatcatactgaatgggcaaaaaccggcagcattccctttgaaaaccggcacaagacaagcttgccctctctcaccactcctattcaacatagtattggaagttctggccagggcaatcagacaagagaaagaaataaacggtattcaagtaggaaaagaggaagtcaaattgtctctgtttgcagatgacatgattgtatatttaggaaaacccatcatctcagcccaaaatctccttaaactgataagcaacttcagcaaagtctcagggtacaaaatcaatgtgcaaaatacacaagtactcctatataccaataaaagacaaacagccaattcatgagtgaactcccatttacaaccactgcaaagagaataaaatacctaggagtacagctaacaagggatgtgagggacctcttcaaggagaactacaagccactgctcaaggaaataagagaggacacaaacaaacggaaaaacattccatcctcatggataggaagaatgaatgtcattaaaatggccacactgcccaaagcaatttatagatttaatgctattccgatcaggctaccattgactttcttcacagaattggaaaaaactactttaaagttcatatggaaccaaaaaagagcctgcatagccaagacaatcctaagcaaaaagaacaaagctggaggcatcatgctacctgacttcaaactatactacaaggctacagtaacacaaacagcatggtactggtaccaaaacagatatatagaccaatggaacagaacagaggcctcagaaatcatgccacatatctacaacaatctgatcttcaacaaacctgacaaaaacaagaaatggggaaagggtaccctaattaataaatggtgctaggaaaactggctagccatatgctagctgaaactggatccctaccttacaccttatacaaaaattaactcaagatggattaaagacttaaacctaaagccataaaaaccctagaagaaaacctaggcaataccattcaggacattggaatgggcaaaggcttcatgactaaaacaccaaaagcaacagcaacaaaagccaaaatagacaaatgggatctgattaaactaaagagcttctgcacagcaaaagaaactatcatcagagtgaacaggcaacctatagaatgggagaaaaattttgcaatctgtccatctgatgtaggcctaatatccagaatctacaaagagcttaaacagatttacaagaaaaaaaacaaacaaacccatcaaaaagtgggcaaaggatatgaacagacatttctcaaaagaaggcatttatgtggccaaaaaacatatgagaaaaagctcatcatctttggtcattatagaaatgcaacacaaaaccacaatgagataccatctcacaccagtaagaatggcaatcattaaaaagtcaggaaacaacagatgctggagaggatgtggggaaataggaatgcttttacactgttggtggaagtgtaaattagttcaaccattgtgggagacagtgtggcgattcctccaggatatagaaccagaaatacccagcaatcctattactaggtatatgcccaaaggattataaatcattctactataaagacacatacacacgtatgtttattgtggcactgttcactataggaaagacttggaaccaacccaaatgcccatcactgatagactggataaagaaaatgtggcacatatacaccacagaatactatgcagccataaaaaaggatgagttcatattctttgtggggacatggatgacactggaaaccatcattctcagcaaactaacacaagaatagataaccaaacaccacatgttctcactcataagtgggagttgaacaatgagaacacatgggcacagggagaggaacatcacatactgggacctgttggggtgtgatgggctaggggacggatagcattaggagaaatacctaatgtatctgatgggttgatgggtgcagcataccaccatggcacgtgtatacctatggaacaaacctgcacgttctgcacatgtaccccagaaattaaagaaattaaagtatatatatataaaaaagaggcctgatagaggtccttcaccctctaccatctgtgagcacacagccagaaggcaccatgtataaaccagaaagtgggttttcaacagacaccaaatttgttggtgtcttgttcttggacttcctagcctccagaatgattttaaaaaatctgttgtttataagctacccagtttatggtattttgttataacagcccaaatagagccccaacccccagtgtggctttatttggtagtgggacccctcagaaactgattaaggttaaatttggtcataaagtgaaaccctgattgaatcaggttagtgttctcatgagaagaaatatcagatagctcactttcccttctcactatgcacacatatcaaagaaaggccatatggacacagcaagatggtggttttctaaaaggcagagagccctcactagaaacttaccatgttggcatcctgatctcagactcagactccagaattgtaagaaaacaaatttctgttccttaagtcacccagtctggaattttgttatgacagcttgaacagactaacacaaaggaagttccctctcctgaatttttaagtaaagttgcccaactggtatgctgtggcaaactagtgtgttattaatggataataggagtgctcagagacattgatcaccctgggatggttatttatttccattttacttcaattttaattgatcctagcatgtcaataattcttctaatttggagaggggagtataatgttcctagaatgtccaaaatgtgaccatttgtccagtcttgggtctcatatctcaatttcattgtgttattaatgtaacagataacaatttcccccataacctcccagcagctacttaaaattacatatgatctcagtgaacgattaagtagcttctggcttcctagaatcattttgattcattcaccaattaattcatctatctatccttccatccattcattcatattttagtagcttgcaaattctatggaaattcagggatcacaaatataaaagttattattcaaactttctttagttcttaactttttatgtaaattttttttcctttgtgtttgagagttgttttccatgaatattagcagtctgtctttactcgtaaatgttttctttgttaaatatagaagtccaataataatataatgtgtgaacagtgtatacataaaattgaatgtttgttgtgtataagacacttttctaaacaaaatacatgaggtatttactaagaaatgcactatcccagggctcatgaaacttctagtggagaagatggataacaaatttataaataagaaaatatcaaatagaaataaatgctctgataaaaattaattggcagtgagagggtctagtaattagattgggtggataggaatgggtttttagaggatatctgatttaaccctagatgagaaaagataagtaagaacaagcaaggagaaaaaatgaacattccagaagaaaagagaagctaatataaaggcagtagacagaagcacatttagcctgctagggatacagagagaaagccacctgaaatccactaagtaagaggagagtggtgctggagacgctcacagaggtaaggcaggggccagattctatgcggcatggtaggtcacagaataaaagttttggatttcattctgagatttgaagtcgttgaagtaggggactgatatggtatgtgatttaccatgaagacaatggatttgaatgtggaccgtaaaattctaagtaggggactggttaagaggctactctagtggcccaggtaagattttatgataggaagggcctagatgaaagcaataaattcacagagaagtagaaagatttggcatatgttttacaagtatagtcagaaggggctgctgataacttagatagcagaagtgagaaagaaaaaaatcaaagatgaatggtagcattttggcttgagaaaccaggtgaatggtgatgccatttgctgacatgggaaaaactgcaggaaaagcagatttggtgagctagaagaaatatttttatatgtattactgttttgcagttcatacttttcatatttaaacacataactaacattttcctaattcaacgtcatattcaaattgtttatattaaaaaatcatttaaaactttcactaatgtaatgtcattttaaagtattttattcttaaaataaaatcattttgaacaaataccatttatttccatttacatgattcctagtaatactcaggttaaaactgaggaaaatgacacctttgtgtcttttttttcttttttttttttttttgagacggagtctcactctgttgcccaggctagagtgcaatggcatgatctcagctcactgcaacctccgcctcccggattcaagcaattctcctgcctcagcctcctgagtagctgggattacaggcacacaccaccatacctggctaatttttgtatttttagtagagatggggtttcaccatgttgatcaggctgctctcaaactcctgacctcatgatctgcccacctcggcctcccaaagtgctgggactacaggagtgagccaccacacccaccttgcatactttttaaataataataccagataatacttgaagtacaggttctcctttctccagccataacttccacaaactgaattttttgacacaaaggcaacaaaatggcttgttttagatatagtattaaagaaaagcttgctaaaaagcaattattcttatatttataccttatatgtacctctcaacttaagagcaaaacaactggatcatatcagccaatttactttcagttttctgaacagatagttggatcttttaggactcagagcaacacagaagccaataccatttgtggtcaacagagcttgtttgattcttctgaacgtattgcagatttatgaaccatctgtgaagaaacaaatggtccaaacctatttaaaatcagcatagctgtgatttgaatgctcacaagtgggtctgaagcagttgctttcctcagcaaactggcctgacacctttgcacaagcttatagccttatgtgatacataagctttaagtttaggtgaagcaaagaacaggaaaataaggaaaatgaaacgaatataaggaagaaagcagtggcataaacttctgtcacgtactgagttcttcctgatttgctagatgcaaaaagttcacttatagcaatggttgcaatttcttcctattttcttagtagcaaatgttttcaatgaagtctctcccattacacacgcacatatactctggtataaatgacttatctaagatatggtataagatcaccataataaagaatatagtttatgaaacatcttacatctcacatgtaataaagctctcctggggatttattgtaatagaatagaaaattacagagatgcacaggcgttacccctctcactttacatctttaatcaatttctgaaaattagacattctgtaaagaagtgctatgctggagcctatttctttatattctacatgggaaaattgtaacacattaaatgttaaccaccaacccttattggatttccaaaaatgaaaatagagcattaaaacattaaagcaggaaaacacactaaaacatgaatttataagtaccgttcacactaatgtacaaattgcttaaaacattgctttttgattatcagttattaaggctgcttacaaatagtatccattgcaatgatgtgactgttagtgacaacgtctcaaatagccatacctattgttgacatttggcatgctttaaaagttcctacatacgattttaaaaacatccgtattgagatatacttaatattccatattagtggtatattaaatcattaaagtgtacaatgtaattgttttaatacatttatagagttgtgcaaccataagttatcaccacagtctaggtttagagcattttcatcaccccaaacagaaaccccatacgcattagagtcattcaccatcccctgtctcctaccatctcccccaccttaagcaaccactaatctactttctgtctgccagattttcctattctggacatttcttataaatgcaatcacacaatatgtgatcttttataaggggtttcattattctaaggtagtaaattacagctttatgatacgttcccttttaaaatttgccttttatacagtttgccttcgccactccactctgagttctacctgtctggtaattttaggtagaacaaaatatttaaaccaatttcatacctggccataaagagtgaaaaaaatagactgggcaagtttgacttaggattaaggtcaaactttctacaggttcctgaataactatgaatcagtccgttaataattatattatttcccttttcccaagcttaccatttctttcatcttctaaggatcatgacgcttcaatctttttttcctctaagatcaggatcttaatttgaagatctaaatttctctacttgatatcttaggcccaaatatgtgagttccaccaggaccgcgctgactacataagtcttactagtccgatgtccactgaaacagtgctttggatctaactttctctttttttgagccattggacagctacagccactgttggatagtagttagggtgaaaaaccaggagcacaatcacttgcatatctgaaatgccacatcctatcatttcagaaagtaacttcatggaagttactcaaattcacgatgccatagtttcttcatctataaaatgggagaatgaaagtgcccaccttatagatttgctgtgagggttgagtgaaatctgcttggcactgaggaagaaattataaaatttagttgttcttcttatatcagctctcaatttcattttttgatctaaaacttcttatgttctcgataatggtagacatctctaatatcctcaaaagcctttctcacactgcttttctcacactctgggcagagagcggttattcattggagaagattataagccaatacagatttactatctttatctgatataataaattttgcttaatctcttattatataacaattacaaatccctctctgagctcttctctctgtggaatatattcaatctgcagttcctttttttcataatgtgtattatatctgacttctttaaaacaaaataaattctagattgtaggaatcttacacttgatcttaagtcttcaattaattttgatttaacaatttccttgttcactattctttctggtttttaaaaataacatcttctttgagatacaattcatatgccaaagaatgtatctttttaaagtgtacaattacaataatcaaaacagtttggtattggcaagagtattgacaaatagatcaatggaacaaagtagagagcccagaaatagatctgtcccgtgatatagtcaacttatctttaacaaaagagcaaaggcaaaacaatgaagtgagacagtcttttcaacaaacggtaatgaaataaccggtcctccacatgccaaaaaaaaaaaaaaaaacaaattaatctagacatagaccttacacccatgacaaaaatcagtttgaaatggctcatagatttaaatataaaatgcaaaactataaactcagagaagaaaatggaagaaatcctatataattttgagtatgacaataacttctttaaaaaaaccaaagttccatgaaagaaataactgttaatctggatttcattaaaattaaaatttctgccctgcaaaagagactatccagagaatgagagagcagccacagacttagaaaactatttcaaaacacacagttgataaagaacgttattaaaactcaacaataataaaataaacaaccagatgaaaaaatgagcaaggggctgggtgcactgactcacccctgtaatctcagtactttggctaaggcaggaggattgcttgagccagagtttcaggttgcaacaggatatgatggcaccactgcactccagcctgagcaacacagccagaccttgtctctaaaagcaaataaataaataaataaacaaatggacaagagacttccttaaagaaaatatacagatagcaagaaagtatataaaaagatgctccacatcatatgttattagagaattgtaacttcataagataacactacacacctactagaatggccaaaattcaaaacattgacaacaccaaatactgatgaggttatggaacaacaggacctctcattcattgctggtaggatgcaaaatggtaccaccactttggaagactggcagtgtttacaaaactaaagatattctcactgtaaaatccagctgtcatgttccttggtacccatcaaaatgaattgaaaactttgaaaacttgtgtctgtacaaaaacctgcacatggatatttatatttaatagcagctttattcataattggcaaaatatggaaactaccaaatatactttagtaggtgaatggataaataaaccttggtatatccagaccatggaatattattcagtgctaaagacttgtgctatcaagccataaaaaaaaaccacgaaaaataaatgcatattattgagtgaaagaagccaatctaaaaaggctacatactgtatgattccagatactggtatacaatatgtgtgaacaggtaaacctgtaaataatagtaaaaacatcagtggtagccagggataaggtggggaggataggatgaataaggagtgtagaaaggatttttagggcagtgaaatgattctaaatgataccgcgatgttggataaatatcattgtacgtttttcaaaactcatagaatgtacaccaagagtaaaccctaaggtaaattatgatcttttgcagataataatgtgttagtttaagttcatctattgtaacaattgtaccactatattatatgtggtgtgggatgtggataatgaaagaggttctgcgtatattgaaacagactgttatggaaaaatctctgtattttctgctcaattttgctatgaacaaaaactgtcctaaaagtttattaattacaaaaaggaagaaaacacaaatatatatatatatatatctatatatctacatacacatacatataaatacacacatacatacatacatatacacacatacatccacatttttaatgcatgtgtatatatgtatatattgatgtgcaattataaatataatttaaaatacaattatgaattacaactataaattatataaaatgtataattgtattacatattatgaattatataattatataaaatattataaatatataattatataaaatttaaaaatatattttaaataatatgtaaatataaatatagcttatataaatacccacatacatattaagtgtgtaatccagtgggtctttgccactttttatcacagaataacacaaccatcatgacatgtatgcacatacatacacatgcatacatacacatacacacacatacatacatatacactttatatatatatatatatatatatatatatatacacacacatacatataaagggtatgattcagtgtttttctgacactttgtcacagaataatgcaactatcatgaatacctaattcaagaacattttcatcaccgtagaaagaaagcaggtatctattagcagtcatttcttgttcccccctctcttctgcccctgacaactacaaacctattttatatctctataggtttgtattttctgggcaattcatatacatggagtcataaaatatgtgttttttgtgtcttctctcttatttaacatgtttgcaagaatcatccatgttgtaacatttatcagtatttcattcctctttgtaattgagtatcattcattatacatattcattatatgcccaggactgggcaatgcattttttacttactggttgatggatatttgatttttttatttgtttccacctttgaactgctttaagtactgcttctttcatatacaatttttatgtggacatatgtttatgattctcttggctatactgctagaaataaaattaggggttcatatggcaactgtttaatgtttgaagactgccaatctgtttttcaaaagtggctgtatcagatgcaggaaaagcactcatgaaattaaacaccctttcttgataaaaattgaataaagtcctggcatgttggctcacgcctgtaattccagcactttgggaggccgaggtgggcacatcacgaggtcaggtgatcaagatcatcctggctaacacggagaaagcccgtctctactaaaaatacaaaaaaattagccgggtgtggtggtgggtgcctgtagtcccagctactcaggaggctgaggcaggagaattgctccaagtcgggaggtggaggttgcagtgagccgagatcatgccactgcactccagtctcggtgacagagtgagaatctgtctcaaaaataaataaataaataaataaataaataaataaataaataaactcaacaaattagatatagcaggaacatacttcaacacagtaaagaccatatatgacaaaaccatagctcatatcatacacaatgggaaaaattttaaagctttttctgtaagatctggaaaaagataaggatgcccactctcaccacttgtattcaacatagtactagaagttgcagccagagcaattaggcaagagggaaaatagggatccaaattggaatagagaaagtcaaactgtccctccttgcagatgacatgatcatacatataaaaaactaggaagactccaccaaaaaactcttagaactaataaatcaattcagtaaagttgcagacacaaaatcaacatacaaaaatcagtagtgttttaatacaccaatagtgaactgtctgaataataaatcaagaatgcaatcccatttacaataactacaaaaataaaataactagaaataaatttaaccatgaaaagaaaatatttatataacataaaatacaaaatactgatgaaatagtttcaggaacacaaaaataaatggaaaactatcctgtgttcatggattgtcagaattagtattgttaaaatgtccatactacccgatatgtgtccccaaccaagtctcaacttgaattgttacccccacatgttgagggagggacctggtgggatgtaattggatcatggaggtggtttctcccatgctgttctcatgataatgaggaagttctctcaagatctgatgttttaaaagtggcagtttcccctgcactcactctctgtctcctgccaccatgtaagatgtaccttgcttcccctttgccttcgctatgattgtaagtttcctggggcctccccagccatgcagaactgtgagtcaattaaacctcttttgtttatagattacccagtttcaggtaatatctttatagcagtgtgagaatggtctaatatactacccaaagtggtctacagattcattgctattcctatcaaaatactaacgacattcttcacagaaatagaaaaaaattccccaaattatataagatcctgaatatccaaagcaactctgagccaaaagaatacaagttactatagctttttagtatattttaatgtcaggtagtggaagcatagtacctgacattaaaatatactaaaacggtatagtaaccaaagcagaatggtactggcataaatggagacacatagatcagtggaacataatagagagcccataaataaattcatacattcacagccaactgattttagacataggtggcaagaatactcattcaacaaggacagtctttttaataaatggtgctgcaaacactaaatattcacatgcagaagaatgaaactagacccctatctctcaccatataaaaaatctactcaaaatgcattaaagacttatatgtaagacttgaaactttgaaactactagaaaacaaaagagaaatgctgcatgacataggactgggcaaggactttttgaaatagacttcaaaggcacaggtaacaaaagcaaaaatagacaaatgggattacaccaaactgaaaagctgctgcacagcaaaggaaccaatcagcagaattggagaacatattcacaaactatacatgtgataaggggttaatatcaaaaatacatagggaactcaaactcaatagctaaaaaaacaagcaacccaactaaaaaatagtcaaaatccctgactagacatttatcaaaagaagatataaaacttgccagcaggtatatgacaaaatgcttaatatcaccaatcattaggaaaatgcaaatcaaaacagtgagatattgcctcacccctcttagaatggctattatcaaaaaaacaaaaaacaaaaaacaaatactagtgagaacacagctaatggagaactcttatacactgttggtaggagcatacattagtacaatgactatggaaaatagtatggaggttcttcaaaaaactaaaaatagaagtatcatatgatccagcagttccactactgggtgttcatccaaaggaaatgaaattagtattcagagacatctgaactcccatgtttgttgcagcactattcacaatagccaagaaatggaataaacctttgttcatcaatagatgaatggataatgaaaatgtggtatatatacacaatggaatattatgcagaaataaaatggaatgaaatcttgtcattcgctacaacatggatgagcttggagaatgttatattaagtgatataagccaggtacagaaagacaaatattacatgttatcttgcatatatggaagctaaaaaagtttgtctcatagaagtaaagaataaaacagtggtttccagaggctggagagtgttggagaagggaaatagtcagaggttggttaacagatacacaaatagataggaggaataggtaagttctagtgttttgtagcactggggagtgactatcatcaacaacaatttgttgcatgttttcaaatagctagaagagtggacttttaatgtatctaacacaagggaatggtaaatgtttgaggcgatgaatattctaattatgctattgatcactgtgcaatgtatatctgtgttgaaacatcatactgtaccccataaatatgtataattattatgtattaattacaaacaaaatagaaagtaaattgatgtatcattttacatccagcaatgtatgtaaatccatctgtaatccacaaagtttccaatttctccttatctttgccaaccctttgcactgtctgtgttttttattatagccatctgaatgggtgtgaaatagaatctcattaaattctttatttgtattgccctggtggccaaagatgttgtaagatatttttaatatttctggatacaagtccatagcagatatgttatttgcaaatattttatcttactcagcgagtgtcttttcactttcttgatggtatactttgaagcacaaagtggtttattttttcaactttgatgtggttcaatctttcattttctatctgtatttatttgcttcctttttttccttttcttattatttttggcttatgctcctagtggcatatctaaaacatcgttgcccaagttaaggttacaaaggtttactcccatcttctcttttaagacatttataattttaatgcctatgtttagatctatgatccatttaaagttaatttttgtacatggtgtgatgtagagatccaacatcaatttttgaatgtagatatatagttgtcccagcaccattttttgaaaagactattctttcctcaataaattatcttggcacacttgtcaaaaagttgtattgccttgatctaaatgtctttcattatgccagttttcacattgtcttaattactgtagctttgcagtaagtttcaaatcaggaactgtgagttcttcaaatttgtttttatttttaaagatcatttggttgttggaaatcccctacattctatgtggactttaggatcatcttttccatttctgaaaagaaaaagcattgaaattttgatagggattgcttgtatctctatattgctttcagtagtaatatcatcttaattttaagtcacccattttaagaaaatgagtgtctttccatttatttagatctactttaattcttcagtatagaagtcctgtacttccttcattaaatttattcctagttattttattcttttttgttgctattataaataaaattgtattcttaaattattttcaaattattcgctatataattgattttcaaatatttgcgtatttttatacttctaggaaagtgttcatttcatctaacataaaatttctttgcatattgttcattgtattcctttatcatcctttttatttctggaaattttgtggtaatgtcccctgtttcatttctgattctagtaacctgagtcgccttcttcttcgtcgtcatcttcttcttcttctttttcttcttcttcttcttcttcttcttcttcttgttcttcttcttcttcttcttcttcttcttcttcttcctcttcctcttctttctcttcctcctcctcctcttcctcctcttcctcttcttcttcctcctcctcctcctcttccacctcctcctccttttcttcttcttcctcctcctcctcatcctcttcctcctcctcatcttcttcttttctacttctttttttcttaaggtggaaagttaggttatatatttgaagtatttttgcatttttaatacaggtgcttacagatataaatttcattctcagcactgctttagctgaaactcataagttatttttgttttcacttacctatctatattttctaatgtcatttgtaatttttttctctgatccattggttattggagagagtatagctgggtgtgatggtgcatgactgtagtcccagctaatagagatcacttaagcccaggagtttgagttcacagtgggcaacatagcaagaccctgtcacacacacaccaaaaaaaggtaggaggaacatctgccaccaagggaccaggacatcaggaagaccggtgcactccaagcagatcttcagaaggaaggcattgagagtggacagagaggaaacactgctaggttgaaggggcaggaatctgggacctctgcatgtagctaccacacatcaggactcattttgacccccagtgacttctggggaaggagtgagtttagcaggcaagaagcgtcccactctcaccacagacctctggaattctggcagcgggagatgtcacaactttcaaggacacttgagctggcagggaaagctgcttagagaggtggaggggcaggacttgatctgatatatgacctcagcaaagtttcaggatatgaaatcaatgtacaaaagtaataacatcctcatactccaacaacatccatgctgagagtcaaatcaagagtccaattccattcacaatagccacaaaaagaatgaaatacctaggaatacagctaactggggtggtgaaagatctctctcatgagaattataaaacactgctcaaagaaatcagaaatgacacaaacaaatggaaaaacattccatgttcattgataggaagaatcaatactgttaatcaatattgttaaaatggtcatattggccaaagtacttaacagattcaatgttattcctatcaaattatcaatgacattcttcattgaattagaatattttaaaattcgtatggaaccaaaatacagactgaatagccaagacaatcctaaacagaaagaacagagctggaggcatcacattacctgacttcaaactatactacatttgcagaaaatgaaaactcgaccacttccttataccatatagaaaaatcaactcaagatatattaaatacttaaatgtaaaacctaaaaccatgaaaaccctgaaggtaacctaggaaataccattctggacatgggaccaggcaaagatttcatgatcaacatggtaaaagcaattgcaacaaaaacaaaacttgacaaatcaggttgggcatggtggcttacactagtagtctcagcagtttgggaggcctagtccggtgaattgcttgagctcaggaactggagactaggctgcataacttagtgagaccctctctctacaaataatacaagtatagccaagcttgctggcacatgcctgtagtcacagctactagagaggctgaggtggcaggattccttgagcctgggaggctgaagttgcagggagctgagatcataccactgcactccagcctgggagacagagtgagagtttttttcaaaagaaaataaaattgaccaatgggacctaattaaattaaaaagcttcttctgcaaggcaaaataaattatcaacaaagtaaacagacaacctacagaatgggagaaaatatttgcaaactgtgaatccaacaaaggtctagtatccaaaaacctatagggaacttaaatatacaagtgaaaaataaccccattaaaaattgggcaaaagacatgaaaagacacttttcaaaagaagatatatatatgaccaacaagcatatgaaacaatgctcaatatcactaatcattagagtaatgcaaataaaaaccacagtgagataccatctcacaccagtcagaatggctattactaaaaagtcaaaaaacgacagatgctgccaaggttgtggaggaaagggaaggcttatacactgctgatggaaatgtaaattagttcactcattgcagaaagcagtttgacaatttctgaaaggacttaaaacagaatgagtactcaaaggaatagaaatcacagcactattcacagtagcaaagacacagaatcaaccttaatgtccatcaacagtagactagataaagaaaatgtggtatatacacaacatggaataccatgcagccatgaaaaagaatgagatcatgtcctttgtagtaacatggttggagctgtaggccattatcctcagcaaattaacacagaaacagaaaaccaaataccacatgatatcacttatgggagctaaacatcaagtatatatggatacaatgaagggaacagcagacattggggcctacttgaaggtggtgggtgtgaggagggtgaggagtgaaaaaatacctatcggatactatgcctattacctgggtgaggaaataatctgtacaccaaacccatataacatacaatttatatatgtagtaaacattcatatgttcccctgaacctaaaatagaagttaaaaatagaaagtaaaaacaattaaataaaatagatactcaagtagtcctaaaataacaaccactaccaaagcaaaacaaaacaaaaaaaatcaaaacaaaacaaaacaaaacaaaaaaccccaaaaccaaacaacaacaacaacaacaacaacaacaacaaaacgaggaagggtgtttcctaatttacacgtatttgtatatttgtgagatttcaaaattttcttctatcatttctaatgtaatctcataatgaataaagaaaatgttttgtatcatttccatcttttaaaatttcttgattcttttcataacgtggtatacttgtatatggtttaaactggaaaatattccaagcacacttgagaagaatgtgtattctgctattgatgagtggtttgttcaatgtggctgctttaaattgttggtcaaatcttctaggtccatttggatcttctacccattcattgaatcctttattcaaagtggtgtataaatgtctccaattcttattgttgcattgtctatttctctcttcaattctgtcagattttgctttctgtcaatttggggtttctattgttatgtgcatatatttttatatttgttatatattcctaaagtgttgactctttcattattgtgacatgcctctctttatttctagcaacactgttttttcattttaatttttttgactgacattaatacagtccctccagttctctgatgattgctgtttgcatgatatcattttccatcattttagtttcaaattacatgaaactttaaatctaaagtgtgtttgctttaaaaagtatgtaggtagattgtttttaaattaaatctggcaatctgtcttttgattggatctttatcaattcacatttaattttatcttgatatggtgtgtgaacattttctgtggcaccattttaattattttaataattgtttaattttatttttgagccatattctcaggggtcactctagggcttgcaatagatatatatcttaagttatcaaaatgacaccagatttccagtaaattccagtaaaatatgaaaactttactcttgcaaatgtcattccccacttttgtgcatatttagatactatatataatgtataatgtctatatatggtaaaaatatttttgtaattatactgtatatatatttagaaagttgatgaaaagtggagagcaagtatatatagtcatagagcttgttattatcttttttatttaccaatttttatcctatttctttctgtaggcttgttatcttacatcatttcattactccaatatagctttgttacacctgcctcctttatgctgttattaccaaatatattacattactatatgttatatggccaacaatataattatgtatacatattgttttattcagttgtttctaaagtaagttaaaagagaaaaggagaagaaaggtgcaattacattgtgttttataattactgactttatgacctttattagcactctgttttttcatgtggatttgaaatactgtttgatgccacttgctttcaactcatggaactttctttcatacaccttctaaggcacatcttttagcaatgatatctctcagctttcatatatctgggaatggtttcatttcaccttcattcatctggaatgtctttatttcacctttatttttgaaagacactttttctggatttaagaatcttggttgatagttttctttcagcattttgatattatctcactgcctctggcctcattatatctgatgagcagtaagttattattctcattggagttccttgcatgtaatgatttgtttttctcttactactttcaaaattctatcttaatattttgttcttaatattttgattataatgtgtctggatggaaatatttttgtatttatcttatttggagtttgttgatatccttaaatgtgtagaatacagtttttcaacaaatttggaaagtaactattttttcaatagtttttctttcccttttgtctcttttcttcacctagttctcccattacatttggctacttaatattttcatatatttctccaagactttgttcactgtacttacaatcaaagaactgcagactatcacaagatagctggcactacagaagacttctagtacaaccaaaccaattatttttattgccttccttattcaaaaagctcaacaaatgttcatcccagcttatgcttgcatatcttcagtgaaggaagtgactaattcttaagtatttcattttgattttatgctggtctaattttaagaaagctttatattaaggaacagtctccccttgttttgattccaagtccccttagcatcataattacccttctctctaaaagcttctgttagttataatcattttcaaaggtgaatcataatcctagaagagctgacatcagagtaaaataataggtttttatctcactgtagatgcatcaattcataaagctgaagttatatcagatattgaagaggtacaaaatacactgttcctccatagttaacgtgaggtcaattaaaagttggatgtcttcacatgaatttgctttaaatcatatatcgtttaatctgtgtttgaatagaattttttaaatggcacacttatatttgctaaaaattttatattcctgggtttagctctttcagtctaaatatttgtaattttattttttattaaatattagctcactcttctggcctcataaaatgtataatcatgttgtttgtacctaattctaatatggtaataaacagaatgatcctgagatagccccttaaaaagctaagttcaggttaacgttgaagcatttataatagttgttaagtaagattattcaactacataaaaactgaggcagggcacaatggctcatgcctgtaatcccagcactttgggaggccgaggtgagtgaatcacccgaggtgaggagtttgagaccaacctgaccaacatagtgaaaccccatctctactaaaaatacaaaattagctgggcgtgctggtgcatgcctgtaatcccagctacttggtaggctgaggctggagaatcacttgaacccgggaggcagaggtaacagtgagccaagatcatgccattgcactccagcctgggcaagaagagagaaactctgtctcgaaaaaaaaaaaaaaaaagtaaaaatgtacccataccttaatattttctattttgtcctaagattattaagaaaatctcttaaattcaaagatctctaaaaatcaagatagcctgtatattacataaataattatttgaacaccaataataatgaaaattagatttatttgacataatgtgtacttagtaatcccctatgggcttccatttcttatctattttctttctaaattctcaaaaaatattatacaatagacacattttttggtataaccacagctacttttcataatacatttcagttctatgggtatatgaggtctaataacaacaataacagcagcagcagcagctaacatttattaacaattattctgtgctagatattttactggaaaattgagtatacacatgtgctagactttatgtcaagtactatccatgcattctctcacttaattttcatagcctacttatgaaatatatgtttttattatagctatttgattataataaaagtccatcaccatggttagtatattactcaagataattaacactagatgccatggcagacaaaacctaaaatcataatggttaacaaaacaaaagttgatttcttgctcattcaaacctaaactggatggggcattcttcgtatgtagtatagctagaccatctgaaacataagctagctctagggatgctaaagcaacgaaataaagagaatggtatgcttagcccagaagtgacacacttactttgagtcagaatttattaaccagtaataaattatgtcaccccaattaaatttaaggaaagctagaaaatgtagagaaacaagtagaatactttgtaagaacaaaattattgccacaagtcaccaaagatcctttgatcccttttcgccaaacattgaacacactcctaaaaaatgacaactgaaatcccatcaagtccagaatctctacgtgtgcagtatctctcaatcaggtctggataagtttttaatccagagacttatgaattaaaagacaaatcatctgccttctgccccacccattcttatacacttaaacatacaaaagtggaagagggaaagactaaccacaagtggaagtacacactctgtgaacttctcctaccttaaggtacaggtggttcctgaattaatccctgattctgctttccgtgtggagttagttctcttgccttctgaatgtgtggagaattacggaattgcctacctcagaggctacaaaagctttttcagtgcactttttagtgctgaagatgaagaaatcaagtgtatatttaagtcttgaatgctcaaaggtattttaggctaaaattctctggtaatccttctctgttaaaattatagatatctgatctattttcttctgtgagttccatatgtggttgatcacagtaaaaattcttttggagtcatatgtagttttcatatctgcttttttttcttaatttcttcccacaattcactctctagcaatttaatggaagttactataaatctggaataatatacgggaagcccatacgcttaatctaaactgtgctgtgagtcataattttcacttaagtttgcgcccttgtctaaaagacttgttaaatttattgttttactatttgttatttagaagcagacagctttccatatgtgcaaggccctaattttggaggtcttctttttcttttattttgtcttgaaaaccagctacttttctgagctctctttttactataaggtaacttgccaaacatagtcaagtacaaccaacacacagaatcaatattccgtcttccagcttcttgccttagagacataaattagtaggcacatagtttgccttccaagttatcacggggaaattctttgctactaaataacttggactgccatcatttcagcccctgatatcaattttttcatctcctataactaatcacaaagataaggccatattttaggttttatgttatgatactaatttctgtatttaatagcataattaatcctaatttccttcacagataaaccctgtaatctcaacagtttagtacagtgaagatttctttatttctcatctaagaatcaatgtgggtcaggaggaccttgcagctatattaatggaacatatggcctctaagatctgcatagcagggaaatagaacaattctcttaatttcttttactctgaaatgatcacttttacttttgctcacagtcaagtggagagactgatcacataatttttacataactgcatgggaagctgggcaatgcaggggagcacatggaatatatggtaccggtgcttataattacaaaataaattcaaacatatctgatttaaatttcaccttcttcctctctgttctcagtagtaaaagtatttaaaatattttaaaagcaatttgaaatattacatagatacaaaaacaaaatacatttttggtttgtttgcatgtttgcttttaatttaacatctggtggcaaagatttctagtcttatatgcatgagtatgccttaattgctcatctggagtaatttagttgatattattttatatcctagactaaaattcagtcattccagcaaacaatttaggagaatggtaaaaaaaaaaagcactgttaaaattgcataaagcacaagtggattgagatcagaaaggtgacaaattggatgaatttggaagaaaaatgttggaggcagaaaatgtaatgtgtttcagtggaaaccataaaatcacctttagagtattcgtttcagatataagtggatttggagcaagacaaagtatataatgaaggtaaaataactaaagactgcataaatctgatcacaggcaggttgatacaatgaccctcaaataattaaacttttgacctttttggctgaataggaagtagcagttttgttctcagaaatatcttttatgtaacagctggcactttctggaaagtatttgaatttacttctttacaactgtatctgaaatatgaatggtccttgaaatggctatagaagattggcccattctgcagctatacttattataaagggttaaaaatcactaacagaacacacacttttaaggtttcaatttcagtcttgtatgccacatcttttcagtataaatcaagaaatttgtatgttaatttctaatactgaaaatgcttcttacagcagccgatgaaataggtattcatgaagtatagcattatttaaaaatgtctgacctacagtgttatatcatttttgtagagaaaaataaaaaaaattggataagcattataaaatgaagctaggagaaataatagctttaatttaagttaaagaagataaaagcacctattattacaaactagctaattaataaaacaagaattttggataatatttatagcaaaatcaatcagcagctaaaatgtcacatacaagtaaattaccatttatttgataatataaatgagacaacataatatctatccttagtcacaagctacaagtaggtgcatggagactttgaacttcataatcttccaaaatttccactgaaaattgtaatatcatccttacaataatatgcaagctccaagacagtaggatttcatatgccctagttgaattttgaatgcctagggctgataaaaatatttatgtagtatcactaatcattaaagaaatgcaaatcaaaaccacaatgaaatgccatctcgcattagtcagaatggttattataaaaagtcaaaaaacgacagatactgacaaggttgtggagaaaagaaaaggtttatacaccgctgatgggaatgtaaattagttcacccactatgggaagcagcttggtgacttctgaaataaaacttcagaattactatttggcctagcaattccattattggacattggacatatacccaaaggaatataaattgttctatcataaagacacatgcacacatgttcattgcagcactattctcaatagcaaagacatgtaatcaacctagatgaccatcaatggtagactgtataaaaaaacgtggtacatacacaagatggaatactatgcagcccccaaaataatgagataatgttctttgcagcaagatggatggagctggaggccattattctaagtgaactaacacaggaacagaaaatgaaataccacaggatctcacttataagtgggagctaaacatcaagtacatatggatacaaagaagggagcaacagacactgggccctactggagagtggagggaggcaagagggagaggattaaaaaaatatgtattgggcactatgcttactacctgagtaaggaaataatctgtacaccaaacccctgtgacatataatttacccatgtaataaacctgcatatgtacccctgaacttaaaatgatatatatatgtatatatataattgtgtgtatatatgtgtgtgtgtgcatgtttagtaataacttatgatttagtaaaaagaaatctaagcataataaaatacctctcaatttcaaaatctgttgaaggggcaggaggaaggagttaaactatctgtccaacaatccactcattttgtttataaaatgagggcatgtaggaagaaaagaagactgtgatgtaatctaatctccatgtcaactggaactccagaaaaaatagagaaattatatttttcaggagaaagacaccttacctattgcatgcctttagcagggtggtccgtggctaaagattatttatatatatcaatatatatatataactgattccttgtctttgctatatatacatatatatatatacacacacacacacatacacacacattatatatataactatacaaattttatagttatatatatatataggttgttaggtaaattgtttgtatgtatatataactatctattgtctatcatctatctatgtagttatatatagttatataatcttttagagacagggtctcgctgtgtcactcaggctaaagtgcaatagcatgatcatagctcactgcaacctgcaaacctcaagtgttcctcctaccttggcctcccaaaactctgagattacaggcatgagccactgtgccctgccaggattgcttctgttaaataaacacagagtctgtaaggtgtgttccctggaaaatgtcaataaactacacaaccctctggaaaataaaatgaaaatattttgtaatgtaaacacttgcctccgttggaagtaaactcataatcctcactagagactttgtttttccaagtcagaagtgcatgttctccaagggaagagaggacctagaaagctacccttgatgtcccagatgtctccttgtttcatttgagtcttttgattgtatccttgatgttattagtacagtttcatactgagataagatctttgatttgtgtcattctaatttgataagccaatcatgttaaactgacttatgaagaagaaaaagaaaggcacatatgttttgtataataataaaatatcatttagactggagcatgttcaagactgaaaggcactgttatacaccaggacaacaggcactaactcagactctctggggccaaactgggacatgtagttatagtacaaatagcatgggtccctttcattagtgtatttatctaataaatattttaaaagttttgccaactttgaaagtctaggtgagaaaatggaataatatggtcccatatgggatttgtaatactcaacaatatattaattattcaggctgatcttatattaacaatataaggattagaaaatacatagaataacatgttattttcatttaaaaattaacaaatcatatattacttttaagggtagtttgattatcaccattatatttagccacacaaatatcagtatttaagaatggtatctaaaagttggaattatggtaataggtgatatgaatagcactcaaattaatctatactctgtcagaaacattaagcatcgcatatatctcaagtaagtcttatataatgtctaatgtttaggaatagctcaaggaatgaagatacaaaagtgtgcaagatatgtaattgataataccagaaccattacttactgaggtgagcttctcttggaaattttagaggtagtataaaatcttgcatattagctaaattatgtgattcttgttcttatcaactaatttaaggaccatagatgggctttggtgatcccatgaacctcctaaaattataaataaaatgcttttgtgctcatatatatatatatattttttaattgagagattaatgtttttatcacgttcttaaatttcttcatatttgggcttgtgaacaaagaagaaaaaataatcagtgctcaggagtaatagtatctaggaaataggtctactgagagatgatccatatggtggggcaatttatgctcacatttatgctctgattatgaagagatctgtagcctagttggaagtaggtacctattagcagactgaaccattttgaaaaaaaatttaatccacagtcattcactcaaattccctttaccttagaaggcaggagtaatatctagaatttattatatccaaaattaactttgtgtatgaagttttgattattcgaatattctgaccataatgttcttttataattcatacatatatattaaattttcaaagtataaatataacaaaatattgataacactaaaaatgcttttggctcttaatttagaatttttgatactcagaaggttgatttctttctttcaatgccttgagattattgagagcataaaaagtgtaaagtttaaaatacctcaaaagtgttaaatattatcaatgtttttactcctttacttccattcactcttaaccttctccaacatggttcctatctctgctccttcgctgaatttgcttttgtcaaggccaccgttgatatctatgttccagattcaataaatactatttagttttcatattccaagacttttggccaggcaaggtggctcacgcttataatcccagcactttgggaggccgaggcaggcgattgcctgagctcaggagttcaagaccagcctgggcaacatggtgaaactccatctctacaaaaaatccaaaagatagctgtgcatggtggcttatgcctgtagtcccagctacttaggaggctgaggtggaggatcgcttgatcctggggggtcgagggtgcactgagccataatcactccactgcactcaaacttaggtgacagagtgagactgtcttaaaacaaacaaacaaacaaacaaacaaacaaacaaaataaaaagaccacacacacaaaggcttttcagctggccttcaacacagttgaacagtccattctttaaaaaaaaaaaaaaacagttttattaaattagtacatgtgtaaaatggagaactgatgaaataaagccactggcaatgaggatctaacagagtttgaccaattcatatgcaaagaagagaaaatcaaatgggataaagacaccatcatgggattaaaaaagaaagatttgaatgtttaagaattaggagaagcccttgagaaaaataagaccttcaaatgattttacaaaagtgattttatgattcttctgtgaaagataaagaaaagtttatctaatcatgacaaattttatcagaataaatgttgtaaaacaaaatcaagatcacatttaaaactaaaattttatcagcaataagacaataggcatttttattcaacaaaaatgattatgaccaaagtctgaaagaaatttaataatttataaaatttaactaatttgtaataattattctgatacttgacagatttcctgaaggaggtacaatgctgacatagccatacagtaacaaagctatcagttcaatgattcttcctaaaaaaatttctcctaattcccaacttctaccccaaatgaggttcttgatatccataaagtaaccttctgaatatgtatatttagaaaatgttgaataagatatgattttttaacattgctgtaatatttttaatgggaatagagaatacatagagaaaagtgcacaaatcacaagtgtataggtggatgaattcttccaaagcatgtaaccaacacacagatcaagaaataatattatcaaaatcctagatgcctgtctgtaatttcttccagtcactactcccctatgaagataattatcattttttagctttttatacacggattacatgtacttttttgtgtctggcttcatttgctccaagatatggatattttatctagaagtctcaacatatatttcatagacttttggatttatacttgcaaatcaacatgcccaatttctaattatattatttactcttcatcaaaatatatttattaaatataattaaaaattcatataactaacctttttgaatgagatgtcttgatgtttttgatttcatgcctagatcttttggttttaattcacataaaatagatgacacatgttttctgtgttcactggaattttttaaatcaacaggataatatatattctgtgaaaataaaataaaagcaatgacaatgataatatctcatgtgttttagagttcttcaagggttttcacatgaattacattatcatgattgattttcatttaaaacatgaaaacaaaaacctgtgaggtaggcagggttaagaaaaaaatttaaaaagctccattgtgtataattttaacaatctgtcattctactaatattgtaccttggccaatgctgtgagagagattgagggaaagagagacctgccaggaaagtgctgtgacaaaaggaacaagggaagagggaaaataaggaataaacaaagagaagcaagatagtgttccccagaaagcctgaaggaagattcagagtaataaagggaggtacaaaattatttcacagagcactaaaaggcagtaacatgggggaggaaaaggagggacaataacaggaagaaaggaagggagaaacgggaccagaattatcacacatgttaaaactacaaatgggccaggcacaggggctcacacctgtaaccctagcactttgggaggccgaggcaggtggatcacctgaggttaggagttcgagcccagcctggccaacatggcgaaaccctgtctctactaaaaatacgaaaattagccaggtgtggtggtgcatgcctgtaatcccagctactcaggaggccaaggcaggaggattacttgaacccagcaggcggacattgcagtgagccaagattgcaccattgcactccagcctgggcaacagagcgagactccgtctcagaaaaaaaaaaaaagaaaagaaaaaggacaaatggatcagctatgtgtgggaagagtagcaagtagcttcatggggaacagaggcattgtcaaatgtaaactgtataatatctgtgaactggttgggatgttttagtgacagtgttatctgttttcctcttcacagttcatccaggactgttacggagctttcatcaggttatcagggacataggctctttcaaaattcctttatcatctcttactgtatctgcatgggtactatcctcaaacttttcacatgagtgaaaatagctactagagctccaaacaccatttcagtcagaagttggaggaaaagggaaatgacaaaaggacacaggccctgtatcttaaggagcttttccagaggttcttcaaataacttctgtttaatatctcattggccccacatccggctatgaaggggagggtaaagaataacgtattttgctaggtgttttgctgcctggaatgaaatttgggcccgttaccatgacagaagaaaagagtagatattggtaggcaaccaatagtccatcagagaaaaagttcagaagcttagatgagggtatgtgtttacatattaaaaaactttctcgggatatgatactttctttggtaagaaacactgatctgacttctgaagactcacaaatatttagtttccatagatctttctgagatctttggttttgtgtatttgtttctggaacatttacatagcgcttatcatttgctattgtgaagttctttatggatattaactcatttaataatcaaaacaaccataaactgagctctttcacatggacatctcatactcaagagaatcaaaacaatatttttttcctccaaatatattagttcttagtcctagtttcagtgaatggcaccacattcatttaagaagaagaaagtcaggtaaactctctgatatgtcacagctgacagaattttgaaatagagaattcatcctcacatttcccccattacttcgacctgttcacttgttcaaacctcctttatttgatgatttagaaaagacacttggatatgtgccttggtcccctgtatttacaattttcttagtttctattatttaaattttatatgtgatattctctaatttacttatcaaaaacaatttgtctccaagcagtgactcatagggtaagggctttttaatgctcattataggtgttaagtatcatctgttcctggaataaacctgtttttatttttcatttaaaaattcttcactcaactcttacacaagacaatttctattcactctttatgtgataaaatcacctcattttgctagaaacacaaataagtacttttaagctcatacattctctttacatttaaaaatttttcaatgttgccaaggataattaaaatttaagaagtcacaataccaaaacatattgtcaaaatatgacacaattttaagtaatgctgcttctattttcatttaggccctggtttttctattagagaagtatgacaaaatacaatgtgtggcactattttgcaattccagtctgtaacaacaactctaaatactttttcaacctcaaattcttctgcaagtcctcttcaagttgcatgatcactctcgtattttcctacttctaagaattttgctctatttggaaacttctctctgtttctgcctcctaacgatgcaattcatcacatgttgaaaatcacctcaaattgcatttgaaccatagaaatgtgtcatttctttcttctatatatctcacttttatcctacccatgataaaataatgagtatgttcagtgatcctgtttccactagtacttacacctttagattcccctgaaaaaaacaagaaccccccccaaaaaaaatctgtcaaatttgagatatccaaactctatcacaaatacagttaatttataaactcatgaaacgtaaagggtcagaaattaagtagacagctagttagctccttttagaaatatattttcttcgtttctcctaattatcctttttcatgtatctggctgtcattgcttgccacattttataaaaatatttccttccatgtttttagaaaagaagaattcatgacaaagggtacatatatgacaggggaacaaatctacagaaagatgaacaaaaagtttaaagctctaaaggaactgaggcttacacaagctgcaaaagtaaagaaatgggcttttctgttatatgtaatgcaagaagggaaagagaatgtgtgcacttactgatagatctttgagctcatagagaaggaaaagttatcagaagactgggaatgatctaataacgatcttactttcaataacagaaagtatatttgattaactaccctactttagacttaacactggtcctcaataattgcagaaaatattttaaggatatttggtagcacttagtaaaggaataataatcaaggaataagttgacaataaactaattatatcaaatacaatttcatttttaacaaggtcaaaattaattcaggttcaaatatccttcgcatggtaaacctgtattcagcagtatgtttgataaaatctttcattacttttagatagagatcagaaacgttgagtgaccatgaaagactgaagattaataaaatgatgccaagctgaagggaggtatctaatgtcatgatacatggttctgttttcagctccattctggtcaacgtttatataaatgagaagtaaaatataaaagaaatgcttgctaccttttccaatgagatagtaaaaaaaacaaaatcaattaataccaaacaaaaatctaagatagtgtcaacagcctggaagtaaattaagcaaatgaagtaaaatagaaataaatattgcagttgggcaacatacgcttaatcactgggatacttggtggtgattttaaaacatgcatgataagacatattatattatatttataaaatacgttttagttaaaagtaaattagttaggaatttgttatgtgatgtgaccctaagctgtattaagcatttcgttgagaaagagagaagcaatagttttaccatattcacttctgaagaactatgtcagatcaggaaaacatatcttcagatgattttggataacctggaacatgaatagtaagcagcttacctactgaattattgtgaacgtaagccctatataaataggctatagataaatccagtatagagaaaagataaagggagattcagagtccctatttcctccactatccatcttcttcattttgaaaaataatgcagaaaaaaataattttttgatcaactcagaaatacttagaatttgttatttaacccttcttctgaaaccttatgcctaagctatcagcaaatcttggcaaggctacttccaaaatatattttaaatatgcttccttctctaaattttcagctacttctctattctacagctataattgtctatttctggtcaatcacaaatgcctcttattggactctgccttcaccatggcttttataatatacattttcatttgtcaaaatgtaaatccaatcatgtttctcttttagctttaagtcctcctactgttcaagatgctaagtcctttctacgaggtatagaacatcatcaaaatatggctcctcaccacacagccaaactcatctcatgctactgttgacttggtttattacagtcctgctatactagatttaatgcagactcttgaacaaaccccaaacaaaataagctattgcatgcctcaggtccttgtgtaagatctttcttctgcctggaacactctccttcccaaaatgtgcatggctagctccttttccttcaggacttaactttaaatattgtctcctcagaaaaaccatccataacaatcttatgagaaatagtcctcctcctattattctctatctcaacatcctacttgttttatttataacatttatcacaattttgtttgctaacgtaggttaagatttgttttgttttgttttttccctagaatctaatccacaagggcaaggacttttcttttcttttttactcaatgctgagaatgttctctgacactcaataaatactcaataattattcattaaatgctgaatgaatatagccaaagagaaatagcagaaggaatgagtggagatttagaaacttcagttcaatatgatgtaaaacaaagctccattctttggagacagtccaacaaccagaaataattttaaaagaaacgtatagcttgtattttctacaggactttgccccaataacacattcaacattctcttcttttcttcctgaattctttcacatctttttgttactccaaagcttctcactcagcaacccttcacaactcttgcatctctttataaactgtttatcacgattctctgaatttagattctctgaattttttggtgtttctatcaacttatcaatttctgaatttgtcacacacacaaaaagcataaacataaacatgtggtaagaataattatatctttagtcagatacatctatctacctgttctgttgattctatatcacacacaaaaaaaaccaaaacagcaattaaagagccatccttaggtaattcagagtgaagaagctaagaaaagataatctataataggtatagaagtgggggagacatagtatattaataaatctcatctaatcataataagaatttctcagagcattattgaaaattggaatagattatctgaggagctatagaactctccacaattgacaaattgaataagtacctggttataaaagtcagatggattatggtactagatatgtattttcccaagagagataatgatttatctttaaaaattaaggagcggtagcagtggtaaccattgcctctatcttctttctagatcaagaataaacactttacactgaactctgctgtctttcaaattcaaggtgcattttcaacccttcctagtttgagtttcccaacttagcctagttagagctctaaaaaattgtaattttgttttcacattctgaatgatacaaatcagagtgctaatccagatcttaccttttccagataatactcaaagagattatactaaaactcaaacaaaaagagtcgcctttatttgtttgaatgaaaatcgttagctctagtgtctggcagcacagcctctcattaacatagtatgcaaagccttcaccttagggggaggttaacgtgtacagcaatccatgtatggcaagtaaatagggttgtcctcaaagtgggtaaactatagagtagcacttggactctgctttcaataataagtactggctaacaagaaaaaccatggagaaaggagcatggttcaaatggtttaaaatgaagttttaccagaaatagttactaaaaagtaactctaaaaagttacttaaaaaagataacccctttaagtgactggcaggtttaactgaggtttgaataattgctactatcctgcatttgatatcaatcttactttatcttaagagagtgaactagaagtgataatacccttgatacgcaggagagaatccaaaaagaatagcctggataaataaacacaggaaacatatagtataaataaaagaaatgtgacatttctcttctacacacaacttagccaagaaatgagggcacctgaatattatattatgctgcaagtgtccagtttaagaacacatgacaaaaaagataatagaaagcttatgttccctcagttcaagaatggtctaatagtctaaggtctatctttactaagattggaggcaccaatgtgtaaattaatgatgcctactcttagctacactacagtgggcacttggtagtagcctttgtagaacccagtgaaaaagagatgttgcaaacttccatgagattttagagcaggttatagtttcaaattgaggaaaaaaacaatgctagtttgtgtattgtagtaattgatactaggtggaataagtaaaagaaaggacatggggaaatttcagaatatatagttttcattttatttgaaaatctctccaaaaatgtatttgattaatttttgtttacgtttcaatacaattctattcacaaccctatttttctagtacgtggattacattatctagtagctaacatattattagtaatgattaaaaataattctatatctttatctaaagatctcattttaaacagagtataactctcccttaaataattaatatcattgtttatagccttcaaagcattcgttgcattctactttatatcatagttatgtccattgctcacccctagtaaaaattactctctctgaggactgaggttgtggtttacttatcttgatatttccgcaccagtttgattgtattcttcaatctgttgtattatcaagtcacaaacaacaaaaaaggataataaatttgattagtttattcaacaactatgtattgaatggcagctatatccatggcataatattaaacataggcacaaagttattattagtaaatatttaaattatgtctttttcaaaatatttcataatttactgattatttccctatgtagatgtgaaaacaagaaaaaaaggcattgaaagtgagaaaaacatagtagaaagcataggctaaattcttaagctcctgattaaaatctgcattttattaaacctcatgttttaggccaattagttacgataatattttcaatttataaatctaatcattttaatgaaagagacatacgtatatgagtaatatgagtttacactgcttaagtaatttgcaattctgaaaagttcatagggtcatgtaaaatttaatgatgggcaataaaatggaattttcaagagggaaattcttttttcttaacaataaaatacatagctcaagactctatatttctaagtatatttgaacaatgtctatatttatgaaagatttagaaaaaagccacaaacggggacttgccaatattttattactgattagtttgctcttactttacctaaacaccttaagtaatccagcaatttagaatttatgtgttttaagtttgagtttgaatctgaggagggatttatattttttcatgagaaaaatgtctcctattaacaaagtagctatatatatataattatatctctaaagtaaggcatattacaatctacttgcatgtactttataaacacatattgataaattatgaaattgactcaataacaattacttgaataatattttctaaaattgaggttttatccccctgcaacttggaacaatatattcattttaggatttcagaatatttcttaagtgttacttcatgtaagtttttattacaatactgaagcctaaaatgactgtctcatatgaagtatagttatgtttcttctccgccaaatgccacatgtatctctaaaacttcagggactctttttatcaaatgatggattatataacaaggcagaaaatacacacacacaaacacacgtgcttatgtatgtacatatatatctcctgaggctcagtctcagtaaactgctatcactcacccaaggtaggcagcctgaaaattctacagcctcagtacaaatcttagtctgtttcactccacattgtattcagcatagcttgcttaataactttatgcctactgctctggtcagaaatatttcagccactgcccaaatgttaattatttacaagactccaatattccggggactggataaggtgactcaaaactgccctagttggcaaaccatttctaccaacaagcttattttaagttcttaagcaattaaggcaagtgttgtcagaatcttgtatattttatttttaaaggccttaatataaagaaatgcctgcaagtgactgtaagtctctctgggctttgtaggtgaattttgtcagcaaaacccaggcttatatggagtatctaaaaaactatcttaactagaccagagagcatcagtgtgattcaatagttaatattttccttccaagtcatgctgcctaaataagttttgagaaaattcagtgctgttgatgtataggtaagtcataaaacacaaatctttgtcatttaaagcttataccaatattgaaacacattgaaatagccaatctctcttacattgaacaaataaaaattcattctaagtaagtggtaaagaatggtgcttttattgatcttattatctttttcattaaaaaaggatgaacagcttaaaagtttttgcattagcagtctctgcaaagcaatttttatgatggtatgtttcattcaatttaagaattgtaatgttagctttcttatatgaggaaggaaataatatcatgaacattttaatgcaagttttaaagtgttaataaatgctagcttgagtgaattactaagtgtatttctcttttcaactttacacttatcttgtgtgtacagctgatatccctagtgtccaatcagagacaagttttcatcctgttgtccaatgaatgatgtgcataattccttttggcactgatgagagatgaatacacacatccagcccacttcagtgaaaattgacccataatttttttttatcctgaagaaaaatacagtaataaagtttaaagatggaaaaaatcagttaaactcttgaggtgtaccattagttaacaataatcagcaaacattacattttgcctggaggacagtgagctcaagatttgcttttaggtgctcatgaattctaataatcttggctctccaaatgatagcaagaaacctaaacatgtgaattttcacatttcaatgagctcaaaagttaaaattcaaaaggacagacatactttttaattattttcttctatctctactgtccccaaatatttttcttgtgaaacgagtgtatgcatttctgataaatatttagcagttgagaatatatatttatttcccacagaaagacaaaaagtgcagatcttatgtaaaactccaatgctgtctctctagtagtattatcaagataataccagaattctaagaattaaggggaaaatgacttggcatactgaggcagactaattgtcatatataccaagtattttacctttaatagtagtaaaaaggaatatgccgtaaaaagttgtttatccaccaaaacattttaattttctttaataacccttaagaatctactattcattaatttatctatgtgatttatttttggtctgttaatatcatcagcctatagaatttccagaataatgaatttcattataatgaccacggtactggtaacccccttactttatctatctttgaagggtattccaagttctactataacaggactgtcaagaaaatcagttttatttctatagctcataactttatgttttattctttgacttgcatcttataatgttaatgtattttctttcaatgattcccttcaatcttcccacccacatacaaatatcacaatgataagcagattctgtcagctattattttatattagggcagtagaataatgttttcacaaaatatatgaaaatgattatgtgatttataagttgtaactcaaaacaatataaatagaatttggattctgctttttaaatgcaacagatactattttaaataaataaatattttttgagtgcatcctatgtgcgtatcactatgctaagtacatggtggcaaaaaaaaaaaaaaaaataaaacacaacctgccataaaatggctaatatttttagtgtaaaaatgttcatatagaatagtcaccttaaaaggaggtcgaatataaataaatttaaataaagacataaacaaacctgaataacatcagagagagactaatttcccctaatactaaaagtgatctttactaaaagagaatgaatcttcattctggatgacatcagagactatgttattttatttaccattgcaagttgaagtgaagagggaaaagataaagaggtacaatcttggaataaattattccaaaataaattgaagtagttaccaggaaggaggttttagcctgggagcccagaatttaatttaaggcaaatgaacaaaggcttttagtgcctactttaagatagcataattgtagaaagaaggcagtgtgctggaatggaggtgaagcagagaaggacatatagtgatgctttttatgtcagacctatctgtgaaaaagactttgctctcaataattgactgattgatacataggcactaagatcaaacacagttaattctaacacacaattctaataatggaatctctcacaatatgcagccatggtttgcttctgagaaaaaagctgctggtagaaataatgctccatctctgtaatcaccctctccatccttcggagctactaaatcaacaaacagagaccccactctctttccagttctagtacctgtgacaggagctatttaagtgtcttcaggccaaaatttagaactcttgataaatttatctttgtgaacagcctaacatataatgctggtagttaggtttttacctcattttgagacttcatcacccctttctgcctttgcaatgtttcccagtttcttcaaacttgacatctgccttgagccatttcctaagcctctattctacctatccagtctttagtccgagttttcttcttaagacaatacttcagcatggtgtctgggatttgatacctgatgacagattccattaaccgacttttaatcttaacctggtccaatttcaatgttgctaaatgcttcatgacagttgctcaactctttcttgccatgtggacaatgaatagagcttacagtactcactggataccagactgattctctttttctaattcctagtgctataaccattctgtctcctgtactgtcatactagcccagtccaaattcttccttagtttaacctattgtgttttaattaatataccatcacctgtgaatctcaagataaagtgtatgtttaagttttaatatgagtaataggctaaaagctctaaaagttatcaaaagattgagctcattggaaagcatcttaaagaaactgggaacatgagttaggcagatgtaaaagagtaaataatacttaatttacattaggaaaacatgaggcaaacaggtaataatggacaaaagactaaagagaatggtgaacagacaacaaaaaacaattaaacagtaagccaaaacacccataaactcctgtaatctataatcctattatgctcttttatctaggctctaggaagttttctacactatcttgtcatctgtaacatttcaccacctacaaaactttaggctgacaggtgtaagaacttactctttactctttccttcatatcttaattacaattaaatagcaatcctaacatttggttgcttatatggaagattaaataataaatgtaacttgtttactcaaagtattttgataaatattatgcatataactccacaactccacatatggtattaaaatatatagagagaacttttattgccaaataatcattttgagtgctcaggtgaaattaaaatgttcattaacagccctatccacttgtttccacattttgtctcatacatctctatgtttaagataatttcctttccattaacacatttgccaagctaattctcacttccacagttttgatcatatagttttcttagttagcattttccttcctctgttcttctgaatagtattatttaaaattttatcttttttttttttttttttttttttttactttttggctttcatttttttcaatgatccaccacagagttggtgtttaattatataaacgtattggtctctatttcatctgtattcctctattacctcatctaaaatgctatttcataaaaaaaaatctaccctctttaattatcccattgcatgttgaggtgaaaaaggcacataagagcatagaatgtgaaatttttagctaatctttagtacttatgtaaaaacaatctgtgttgatatctgtattgatacttatatctataaatttgtgtgagtacctatctacggacctttaagtatatgagcaaaactgattttttaattataaagaccatcatatttgcattatactgtgtggccgaacagtgggataaatcagtatttctataggtaaaaaagtcatcaggctgggggccgtggctcacagctgtaatctcagcaccttgggaggctgaggcaggtggatcatgaggtcaggagttcaagaccagcctggccaatacggtgaaaccctgtctctactaaaaatacaaacattagctgggtgtgatggcgcctgtagtcccagctacttgggaggctgaggcagaagaattgcttgaacccaggaggcagaagttacagtgagtggagattgcgccactgcactccagcctcggcaacagagtgagactccatcaaacaaacaaacaaaaaaacaaaacaaaaaaaaacaattgtctctcagatatttgaatattctttccatatgtcaactctcagaaactaactctccacatagatttctatccattatgagtctaaaaattacaaacatttcgtaagttttttcagagaaaataacacaacattcatacacatgggaggaattatttgcatgttaatttctgaaatttattataatgacataaaatgcttacattttaggataatagatttaaatattaagcataaaacaataacaaactataccattgaagattcttaagattttttgtccttcagtagtagcataccttttaaataatataaattattcaatgccaaaattatatatacagacatacgtatcaataaaatagaacttagagtccaggaataaatccttcaatatagtcaattgaattctgacaacagtaccaagataattcaatagagataagaaatttttctcaacaaatggtagtgggacaagtggatatctatatgtaaaataataaagtcaaacctttacctcacaccacatgaaaattagctcatgatagattataggtctaaatataagagctaatactataaacgcttagaagaaaacatagaaaaaaaatctttgaggcctcaagtgaaagaatggtttcttagatatgacacaaaaaataaaggcaacaagaaaaaaatataaatgtaagtttaccaaaataaaaagcatctgggatttaaagaataccattgagaaagtgaaaagacaacccacataatgagaaaataactcacaaattatatatgtgataaaagatttgtatcaagaatatgtaaagaattctcacaactcaataataaaaagataatctattataaaatgatcaaaggatttaaatagacagttctccatagaagatatataaagggacaataaatacacaaaaagatgctggcatcatcaactgctaggggaatgcaaattaaaaccaccatgagattactttgtatcctgtagaacagttataatcataaagacataaaataacaagtattggttgggttttggagaaattgtaactctcatgcatttatcatgtgaatgcaaaatggtacaactgctatggaaaactgttcggcagtttctcaaaaagtcaagtgtagaattaccatatcatccagtaatttcacttttaggtatacccaagaaaactaaaaacatatattcattcagcaatttgtacatggatgtttagagcagcatagttaaaaatatccataaattagaaggaactcaacgaatgaatggaaaaacaaaatgtggcatatccatacaatggaatattattgagccataaaaaataaatgaattgttgataaatgttacaacatgtttgacatgagatttgggcagtgaaaaaaagtgtttcaacatggatgactcttgaaaacattatactaagtggaagtagccagacataaaataacatatatgcatgattccgcttatattaaatgccaagaatagacaaattaatggagagagaaaatagattaatgttcccaggggctgtagagagaatttctaatgggtatggggtttcttctggggaataatgaaaattttatttaattagtgatgatcgtttcacaaatttgtgaatatactaaaaacaactggactggacacttaaaatgttttattttaatggtatgtgaattacatctcagtaaagatgtttttaaaaatggtgaagttggcaatgtagcttcagtagtgtttctcaaaattataacaaaatgtaaacaatgtgagataccaaagataattaacataatagcaagagacctgagaaaattattataatttttcaggcaatttaggattcacattttcaaaaactgtaacactttttactatttctagtggtaactcaagaatgtaaaaagaagccaagtaaatatgaattttactatgtttttactgtttgataaaactgaagctcaaaataactaaaatgcagaaaacaacatatttatcattaattactagctataacacttccagaactttcatttaaacttggtaataggatcttatgcattttctgtctttggggatccaaatataaattatttgatggcatctacagaattataataaatcaggattcaagatagactagtcagaatggaataaaaaatctacaaaatagttttttttttaaaactgaagtgctaggaagatgagaaaactatgagagaactttaaaacttaaaaataaattataaaatcaacacaaagtacatcagatttagtatttaaaatacagctaaaaagagataatgattatcaggtcaaaagaagactgtaccagaaatacttagtaatgaaaataaaatttggagagtagagacatccataaccaggactggtaaaatataaatttggactaattctcaagtttcaaaaagccttatgaaagatttgtttaggccaggcatggtggctcacatctgtaatcccagcactttgaaaggccaatgtaggaggactgcttgagcccaggatttcaagaccagcctgggcaacaaccttgtctctaaaaaaaaagtataataataaaatttaacttagctgggtgtgggagtgtgtgcctgtattaccaactactagagaggttgaagtggaaggactgcttgagtccaggaggtcaagattggagtgagccatgaatgtgttacttcactccagcctgggcaacaaacagagtgagacactatctcaaaaagaataagtaaatacataaatcaaaataaaaaaattaaaagtcttttgaaaattaggaaagagctaccaagaaagctaggacttatcaggtcaaaatttaagagaaggcaagatcccccaaaggtaagtcctcaaagatgcttttgttctgataaaatttgcagatcaggaataactttggtggctcaaggagatcaggaatcaaaaatcaaatcccatgttcaccaaagtagaaggtcctgtccatagtgagctggaaactcacacagctacagcatgatacaagtaaacatggaataaaacaggctgtaaattaaaatgatacctgaataatccataaaatctcgagatttaaattgtgtcatggtcaaatattggtggtgattcagtttctagtggtagaaaatggaaacactatctggaggaaagtaccttcattctaaggcctaaaattttcacaattgatatttcaaatacaatgagcagtacacaagacctgaggtatcaaatgaacatgaacaaagactatagagttactctgcttattatttttcaataaagaatgaacaattttgatatatctgcaggaaagaacaaaaaattaaaatttattgattaaacgtagctaacaagaaaattagtgaactggaagagtaattgaaaaaaatttcagaaagcatcaaagagaaaccaaaaacaagtgaaattcaaagaagagaaaaagaaccatagagaatacaagcttattagtaaaaagtaacaaacatcctatagcaagatttttgacatcagtgcaacctagctttgctttaactgtctcaggcaaataaatgtcttaataattcaagtggaaagtatctattttattttataatattttattataacattctacctccattaaatactttctttacttcttgattattttctattgctttgccaattgctttccatacctactctgcagcaaagacttatatttgttctttaatattcgtttacctttgttttcataatagaatctctgatttttgtctgggcacatttctgcttaaaataatgcctacatatttcagccttccttgcagctgaatgtaatgataaaaccaaaatctagccaaagatatattgtgtggcatcatttagaaaccttacttaaaacacatctgcaagttccctcacacttttattttctatctcttcctctttcttgatggctggagtgtgcatgtgatgggtggagtaagtgcagtcattttgggtcatgaggtactatttgactggaggtcatgttcagaaaagcatgagataaaaacagtcagtcactaagtactgagtgaaatagttccataatatcagtcctagactgtatacctctggagttttacctgagaggtgaacaaacatattagtatcattttagatctttattacacatagctgaatctaatttaaactgatagcaatatggtagctggaagtgggatggtacagatgaaagaaatgtaaaacatttgacaccaccttagtacaggagattgggtgaccagtgataaggactcaagatattataggctgaagagctggtgacccttgttattatggcttcaaaacattttcactttggaaggcaggctacatgctgactgagtgtgttgtgttacagaaattttcaaacaaataccgtaattgagtgtgtcttagatgttacttgtagcttttatttaagtcttttgagagaaaaaaaaatctgggttatatctagccaggctgaaataagagatggaaatagaataaaatttttgataaggcaggtactctttgaagtctgcaagttaagcttactgagattctagtgattcagggccttgtgtaggtgaaaaaaccaacatctcgttcctcaaattgaagcggttacaataggggacttcaaagtagaaataagacttatatacaaaggtgtaaatgtctgcaggaaagatgagattaagaattttgtcttccctccaacacccattgtttcagaaagttcacctatggtcactatcgttaatttggaagagaggaaaatgagtagagaacaaaaaccagtaagtgaaagatcagaagcttcaggattataaacaatgtctaaacaagatctttctacttgcttaaggatagaaactactgacatcaaataaatcagaagcatactaagtttttgaatgaaatgtattaccaaaaaaaaaaagtctgtcctaaaaatacctgtggttcttcaatctctatagcaacccacaggcccctaaatctattaagactatgaaactccaacactcaggaggaacaaattccctaatacctaattctgatgttgccataaatatgaataaacaggtaagatgttttcacagggaaaatataggagatttttccagatgtgtttactctatttcaaaagaagagagtgtttactattcctatcagactgatttggtaactgctatgggggcagaaacaactgtgtttcccttttccaaattagagttttattataggtatgctgtttctatgccactttatatgctaggtatgtataaggtgaatattttataatttagctataggttgctagactatgagttatatcttgtctaagtgaagcagactggacatctaccaatataacgattggaattaagtttagctgcaagtagtgacttattcaatataggagtacttccatctcacatgaatatctgaatgtaagaagaccagggctggtatgaaaactgcaattttctgttatccaggatacttccaagtttccactcattcatggtctaaaatgaagttccaagccacagaatgaaggaaggcagaaagaagagacaaaatccattgccaactgtcttttggggacatttctcagaatctgccaaatacttcccttcatgacatggtttgatgagctgaataaagggctgccaaatcatctatgtcctaatcccctgaaccctgtgaatgtcaccttatatattagttgggtagggcttccatagactgactggcttaaaacatagtcttttttttctcacaggtctgaaagttggaagtccaaggtaaaggttccagctgattcagcttctgatgagggctgttactggcttgccgatgacaaccttctcactatgtcctgatatagtctttcctcagtatgtgcacatggggttgggggagggggagattcttaatcctatcaggtcaggaccccatccttatgacctcatttaaccttaattacttctttagagtccccatctccaaatatagccacacaagtttagaatttcaacgtatgaattttgaagggacacattcagctcataacactttataggcaaaaagatatttgcagatgtgattaaggatgttgagatgagttgattattgtggtgtgcctgataaaataataggggtctttgtaagagggaggcaggacattagagaggatgtatgtaagagatgagatgacagaagcaagaggttagggtgatgtgaggtaggggtcacaagccacagaatataggcagcttccagaaactagactaggcaagaaaacagattctgccctttgaaaaacatcagccatgtaaacactttgatttagtcaagtaaagccaattttagtcttctggaactataaaggaatgaatttatcccattttaagccaccaaatttgtagtaatagaaaactaatatacatgccaatacttaattgctagagaagctgagaaatgcaaattaatccagacagctaaaatttggggatgctattagagaggaagagagatatgatagatattagagggcaaacatcacttactgccacaaccagaaatgatggaattttttctgactattatagtgacataagcttttaggtttgctccctttggtagaggctttgtgttctgtttttggaaaaggtacaggcaaatgtttgaaattgtccttcaatagtcattccaatcttattctataataaaggaaactcatgttttagctgggcatttggatgatcttaatgagactttatttcttagcctcttgtagctatgagcccaatttgtggggcctaccagatataagcagagtgttgcatggcagcttctaggaactttccaaaagtaaacacaatagctgtgacctcttcttctttatttcctcttctttctggcaggttagaatgaaagcataatgactggatctggtgaaactattgtggaccacaagaggacctgcaaaatagaggccatgtatgctggagcaacaggatggaaggagtgaagaactctgagaacattatgatgcagagttgttataccagcaatgcactgtctatctcttgatttttatgtgagagaacagttgttttgtttacatcgctattagggatgattactcccaattctaactattgcattctcttccttctttattatttctctcatagaactgttcatgtaaatttttactcgtgtctctacatacatatccataacatgtataacaaaattttgtctttgaaaatgtaacattagtgaagttatttaaaggcatatgtgttgtgaactattataactaagatattgggaaggaaatttgttaaatatattattcctaaatctcataagcaacttacattaagcacaggaattctagctaatgagtaagaatgcttttttatgtagacagtatattcaatattggatacttttgtactctaaaatcatagccatatataactaaaccatggtcacatgggaacatagtaaataaaaaatgtaaaaatacatttaggtcattactgctaacttataagtttatccaaaacattcctaatctaagtgttactttacaatcatatagttatatttaaaaagaaatgataaaaattatatctgatggagatgtttagcagagggtctcaaactttttggtcagaggactcctttatttgcttcaaaattatgaggcccctaaaatcttttatttatgtgtattatattctttcaatatttaccatactagaaattcaaagtgtaaaaagtttaaagtatgcattaatttatttaaaataacaataagaaacccattttattttcatgaaattacacactattataaaacagaactatatttcaaaaaaaataactgttaagagtggaactggtctatatttttaagaatagatttagtgtctggcttaataacccagagattttcatatctgtttatatattaaatctcttattgtatcatgtcatgcagcctctggaaaaactccatgatacagtaatgggagaatgagaatcaaaaaggaaaatactgttttagtattattataaaagctatattggtatggtggatcctttaaaaagatttcaggaacctaaggtggtccctgaactacactttgagaaccactattatacagaataactacaaagataaatcttacaaaactggaccaa

SEQ ID NO: 25 - DNA, 12740 bp, Homo sapiens
tgtttgcttattggtctacagagatattatactcaccttgagtccattttgatggtttgtatttgctagatatcattcttattttggcagataagtgccatccaacttttccatgtcatggcaaacaaagaaaatgatattatttgtttattactgaaaacaaaccaagtaacttgtggctggaagggacctgccaaaaaggtgcagaggattacggctgccctaggcttgcgctgactgctgaaccataaccccttatgggcaagactatgtggcacagtaagctagtgagaagtttttctctagactttaatatttcatagttttgtaggctagtcatctatataattttaatcttattagtaattttggttacagatcttctcattacttttctgtttttttaattatactttaagttttagggtgcatgtgcacaacgtgcaggttagttacatatgtatacatgtgccatgttggtgtgctgcacccagtaacttgtcatttaacattacatatatctccaaatgctatccctcccccctccccccaccccacaacaggccccagtgtgtgatgttccccttcctgtgtccatgtgttctcagtgttcaattcccacctatgagtgagaacatgcagtttttggttttttgtccttgcgacagtttgctgagaatgatggtttccagcttcatccatgtccctacaaaggacatgaactcatcattttttatggctgcatagtattccatggtgtatatgtgtcacggtttcttaatccagtctatcattgttggacatttgacttggttccaagtctttgctattgtgaatagtgccgcaataaacatacatgtgcatgtgtctttatagcagcatgatttataatcctttgggtatatacccagtaatgggatggctgcgtcaaatggtatttctagttctagatccctgaggaatcgccacactgacttccacaatggttgaactagtgtacagtcccatcaacagtgtaaaagtgttcctatttctccacatcctctcaggcacctgttgtttcctgactttttaatgatcgctattctaattggtgtgagatgttatctcatagttttgattcacatttctctgatggccagtgatgatgagcattttttcatgtgtcttttggctgcataaatgtcttcttttgagaagtgtctgttcatatccttcgcccactttttgatggggttgtttttttcttataaatttgttggagttccatggtactggtaccaaaacagagatatagaccaatggaacagaacagagccctcagaaataatgccgcatatctacaatcatctaatctttgacaactctgacaaaaacaagaaatggggaaaggtttccctatttaataaatggtgctgggaaaactggctagccatacgtagaaagctgaaactggatgccttccttacaccttatacaaaaattaattcaagatggattaaagacttaaatgttagacataaaaccataaaagccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacatgcaacctacagaatgggagaaaaattttgcaatctactcatctgacaaagagctaatatccagaatctacaatgaacttctcgttacttttctaaaatatttttttctggcctgggcctatttcattagtcttttgagagaataaacatttagcccccactcatttgtgggagctaaaaattaaaagcattatttcctaactctagtttttttgttcaacttctgtgttaattttccattccaacttttatttacttatttttaaatttttaatttttgtaggtacataggaggtgtatatagttatggggtacatgagatattttgatacaggcctataatgcataacaatgtcatcaggattaatggggtatccatcacctcaagcatttatcctttctttgttttacaaacaatccacacatattctttcagttattttataatgtacaattaattattcttaactatagtcactctggtgtgctattaaatactagatcttattcattacatctaactgtatttttatgcccattaactgtccccattccacccaccctactacccttcccagcttctggtaaccatcattctatctctacttccatgaattcaactgttttaattttcagctcctataaatgagtgagaataagcaaagtttgtctttctgtgtctgccttatttcacttaacataatgacttccaattccagccatgttgttgcaaatgacaggatctcattctttttctgtggctgaatagtatttcattgtgtatatgtaccacattttctttattcattcattcatttgttgatggacacttaggttactttcaaatcttggctatggtgaatattgccacaataaacataggagcacagatatatcttcaacagactgattgcctttactttgggtatgtccttagcagtgggaatgctggatcatatggtagtttttgtagatatttgaggaacatccaagctgttgtccatagtggttgtcctaatctacattcctaccaacaatgccaatgtcaaattatactacagagatatagtaaccaaaacaacatagtactgtcataaaaacagacatctacagatgtctctatatctgtgccagcatttgtttttgcctgtctctgataatagccattttaaatagggtgagatggtatctcaatgtagctttgatttatgtttttctgatgataaattatattgagcacattttcatatatatgttttccatgtatatgtcttcttttgagaagtgttcattcagaacttttgcccattttctaatcaaattattagattttttcctatagagttgtttgagctccttatatattgtagctattaattcattgtcacatggatattttgcaaatatattatcaatttctgcaggttgtctcttcattttattgtttcctttgctgtgcagaagctctttaactttatgtgatcccatttgtctaattttgtttggttgcctgtgcttgtggagtattactcaaagcttgttgcacagtccaatgtcctggagaatttccccaacgttttcttatagtagtttcatagtttgaggtattagcgttaagctgcaaatccattttgatgtgatttttctatatggtcagagatggtggtccaatatcattgctctgactgcagatacccaattttcccaacaccacttactgaagagactgtctttctccaatgcatgttcttggcacctttatcaaaaatcagttcactgtagatatatagatttggttctgagttctctattctattccattgttctatatgtctgtttttagaacagtcctatgttgttttggttactatatctctgtagtataatttgaagtcaggtaatatgattcctcctgttttgttcttcttggtcaagctgactttggctattctgggtcatttgtggttccataaaaattttaggattgttttctctatttctgtgaagaatgtcattgatattttggtagggattgcattgaatctatagattgctttgagtagtatggacattttaaaaatattaattattctaatccaggaacatatgtatttccattttttttgtatcctcttcaatttctttcatcaatgttttaagttttcattgtagagattgctcacttctttggttaagttaattcctaggtatctaattttatttctagctattgttaatgggattaatttcttgatttatttttcagattgttcactgttggcatacagaaatgctactggtttttctatgttgattttgtatcctgcaactatactgaatttattcatctgttctcaatttttttggtgggatttttgggtgttttcaaatataagattataccatctgcaaacaaagataatttgacttattcctttccaatttgaatgccctttatttctttcttttgcctgattgctctagctaggacttcaagtactatgttgaataacagtgatgaaagtggacatccttgttgtgttccagatcttagagaaaagccagttttttcctattcagtctgaatctagctgtaggtctttagtacacagcttttattttgttgaggtatgttcattctatatctagtttatttaggtttttatcataaagggatattggattgtgtcaaatgctttttcagtatcaattaaaataattatataatttttgtccttcaattctgttaatataatgcaccacattgattgatttatgtacgttgaaccatccttgcattcctgggataaattccacttggtggtgatgaatgctctttttaatgtgttgttgattttggtttgctgttattttgttgaggatttttgcatcaatgtttatcagggattctggaatgtagttttctgtttttgacctgtctttttctgattcttttatcaggataatactggccttgtagaatgagattggaagtattccttactcctctatttttgggaacagtttgaataggattggtgttagttcttctttaattgtttagtaaaactcatcagtgaagccatcaggtcctgatgttttctttgctaggagacttcctattacagcttcgatcttattacttgtttttgctctgtttaggttttggatcgtttcacggttcaatcttagtaagttgtatgtgtataaggatttattcattttttctaggttttccaatttatttgcatatagtttctcatcgtatcaactaataatctttcggatttctgtggtattgcttgtgatgtctctactatcatctctgattttgctgatttgggtcttctctctttttttcttggataatctggctaagggtttgttgattatatttatcttttaaccaccaatttttcatttcattggtcttttgtattattcacctcatttcaatttcatttatttctgctctgatctttattacgatcttgtcttctactaattttgggttccatttgcttttgcttttctagttctttaagatgcattgttaggttgtttaaagattttttaatatatctgatattggtgcttatagctataaatttacctcttagtagtgctctcactgtattttataatatttggtaggttctgcttccattatcattcgtttaaagaaatttttaaatttccttcataatctgctcattgacccactggtcattcaggagcatattgtttaatttccatgtgtttgtatagtttccaaaattcctctggttgatttctagttttattccattgtcatcagaggagacacttgatataatttcaattattaaaaaaattttaagacttgttttgttgtctaatatatggtctatccctgagaatgatctatgtgctgagaagaagcatgtgtattcagcagccactggatgaaatgctctgtaaatatctattaggtctatttggtctataatgtagtctaagtccagtgtttctttgttgattgtttttgtctgagtgatctctccaatactgaaagtggggtgctgaggtctccagctattttggttttgtggtctagctccctctttttctctaataatatttgctttatatatttgggtgctccagtgttgggtgcatatatatttaaaattgttatatccccttgctgaattgacctctgtaccattatataataaccttctttgcctccgtttatagtttttgtattgaaatgtatcatgtctggtataagtattcctgatcctttttagtttgcattggcatggaatatctttttccattccttattttcagtccatgtgtgtctttataggtgaagtgtatttcttactggtaaccaatcattgagtcttgttttttcatccattcagccactctatgcttttgattggagaggttagtctatttacattcaatgttattgttgataggtaagattttactcttgccattttgttatttgttttctagttgatttgtgatcttctcttctttctttcctgtcttccttttagtggtatgttttaatttcttggtttttgtgtgtgtatctgctgtattttttttatttgaagataccatgacccttgcaaatgatattctataactcattattttaaactgatgacttaataatgattgtataaacaaaaaaagagaattgtaataaaaattcgacactggacttcatccttctgctttttaactttttgttgcttctatttacatcttagtatgctgtctatgtcttgaaaagttgttgtagttattatttttgaatagttatcttctaggttgtttttactcaagatatgactagtttagacaccacaattacagtgttaaaatattctgtgtttttctgtgtacttactattaccactgagttttgtattatcagatgatttcttattgctcattaacttccttttctttctggttgaagtactccttttagcagttctggtaggcaagtctggtattgatgaaatccctcagtttttgtttgtatggaaaattatatcttcttcctatatgaaggatatttttactggacatactattctaggatacagctttttttccttcagcactttaaatatatcctgccattctctcctggcctaaaagttttccactgcaaagtctgttgccagatatattggagctccatgtatgtgaattgtttcttttctcttgctgctttcaggaatttttctttatctttgacttttaggtgtttgattattaaataccttgaggttggcttctttgggttaaatctctttggtgtacaatagctttcttgtacttagatattgacatctttctctaggtttgggaagttctctgtttttatctcatttttttgtctcctctgtatgttttgtgatggcatgtcttaaagctcactaattcttacttctacttcattaattcttctggtaagagaccgatttactcttcagtatctcaattgcatttttcaactccagagtttttgcttcattctttttaattattcaatatgtttgctaaattgatctcataggattctggactccatctctatgttatcttgaatatctttgagttccctcaagaaggctattttaaatcatctgtctgaaagttcacatatgtctctctcaacaggattagtccctggttcattatttaggttgtttggtgaggtcatgttttcctggatagtcttgatgcttgtgaatgtttatcagtgtctggccactgaagaattgggtatttattggactctttgcagtctgaggttgtttgtatgtgtgcttcttgggaaggtttttcagatatttaaaggaatttgggtgttgtgatctaagtttttgatctctgtagtcatatatacattagggggcaacccaagcccagtaatgctgtggctcttaaagattcatacaggtacttccacgaaattcttcttggatagttctggaagaattatctggattgcaaagcaaaaacgcttgttctcttcctactttcccctggataaacagtctctctctgtgatgagctacatatagttgaggaagggtggcataagcatccctgtggccaccaccactggaactgtgctaggtcagatctaaagccagcacagaactggatctcaaccaagtctttcagtaaccactgccttgctattttctatgttcactcgagcctgcagagctttaaaatcagcagttggtgaagccagccaggcttgttttcttttcttcagtgtggcaagttccccttggtcccaggtaggtcaagagatgccatccaagagccagcaccttgagtcagttactttaggaatctacctgtcacccaagccacaaaacaaagtccttccctacttccctcctctacccacaagcagagaagtctctccctgtaactatcaccaccccagttatgtggtgagtgagtattacctggttacctctgatgtttattcaaggacccagggctctttagttagcttgtggtaaatgctgccaggcctaggactctcccttcagtgaagtgagctcccctctggaccagagagggtacagcaatgccatctcagagccaagaccaaagcctggaatctgagacccttggtgctctactctgtttgggccaagctggtacctaatctgcaagatgaagtcaccttttctctccctccatttttcctcgagaagaaggagtccctagctatagccaccacagctggaaatgtgcagggtcacatctgaagccagtatgtctctcagtctcaaccaaggcccaccatgagtactgcctgggtaccactgctgattattcagtacctaagggatctttagctaggagataatgaatccttccaggactgggtctttctcttcaagacagtggattctcttctggcccagggtatgtctagaaatgttgtccaagagctaggtcctggaataggggcctcaggactctgcctcatgcccacttctactgtgggtgaacatgtatcaaagttgcccccccaccaaaaaaaagtcctccttacttatctctctcttctcttcaaacagaaggcagaagtctctcttggagttgcaagctatgttgtctagtgttgggtgaggggtgatgcaaaccctcccttggctgcttctctggcatctcatttggttatgctcccctgtcaactccactgactctgagccagcccagcaccaggacttgcccacagattgcagactttgtggtctagactgcctttcaagttaatgtaggcctccccagagcactttagccccgggtaaggtggtgaggcttgttagaacttaggctctgaccactgggatgagcaacttccctatggctatggctgatctcaatgcacattccatgagcactggctgagttccaccaagtgccactttccactgtgacagggcagcactaaatttcaatgcaaagttccacaattactgtgttctcactctctcccaagtgcagattctctttccacgccatgtggccactgccagagtgtgggggaagggtgatgttggcaattaaggactggctttcctaccctcttgagtggctccttcattgatatgaagataaaaccaaatatagtgatcactcacttgatttttggttcttataaatgtgattttttttgtgccgatagttcttcaatttggtgcttctgcaaggaggatgatcagtagaggtttctattcttctacggtgcgttacctctttcaatcagtatttctacttttaagaggtattgttgtttgtttttaaataaaaatctctaaaggcccacaagagaaagcaggaaagatctaaaattgacaccctaacatcacaattaaaagaactagagaagcaagagcaaacacattcaaaagatagcagaaggcaagaaataactaagatcagagcagaactgaaggagataaagacacaaaaaacccttcaaagaatcaatgaatcctggagctggttttttgaaaagatcaacaaaattgatagaccaccagcaagactaatacagaagaaaagaaagaagaatcaaatagacacaataaaatatgataatggagatattaccaccacagaaatacaaactaccatcaaagaatactataaacatctctactcaaataaactagatatctagaagaaatggataaattcctggacacatacaccctcccaagactaaaccaggaggaagctgaatccctgaatagaccaataacaggctctgaaattgaggtaataattaatagcctacagaccaaaaaaagtccaggaccagacagattcacagccgaattctactagacgtacaaggaggagctggtaccattccttctgaaaatattccaatcaatagaaaaagagggaatcctccctaactcatcctatgaggccagcatcatcctgataccaaagcctggcagagacacaacaaaaaaagagaattttagaccaatatccctgatgaacatcaatgcaaaattcctcgataaaatactggcaaaccgaatccagcagcacatcaaaaagcttatccaccatgatcaagtgggcttcaaccctgggattcaaggctggttcaacatatgcaaatcaataaatgtaatccagcatataaacagaaccaaagacaaaaaccacatgattatctcaacagatgcagaaaaggcctttgacaaaattcaacaacccttcatgctaagaactctcaataaattaggtattgatgagatgtatctcaaaataataaagagctatttatgacaaacccacagccaatatcatactgaatgggcaaaaactggaagcattccctttgaaaactggcacaagacagggatgccctctctcaccactcctatttaacatagtgttggaagttctggccaaagcaatcgggcaggagaaagaaataaagggtattcaattaggaaaagaggaagtcaaattgttcctgtttgcagatgaaatgactgtatatttagaaaaccccattgtctcagcacaaaatctccttaagctgataagcaacttcagcaaagtctcaggatacaaaatcaatgtgcaaatatcacaaacgttcttatgcaccaataacagacagagagccaaatcatgagtgaactcccattcacaactgcatcaaagagaataaaatacctaggaatccaacttacaagggatgtgaaggacctcttcaaggagaactacaaacgactgatcaatgaaataaaagaggacacaaacaaatggaagaacattccattctcacggataggatgaatcaatattgtgaaaatggccatattgcccaaggtaatttatagattcaatgccatccccatcaaactaccaatgactttcttggaaaaaactactttaaagttcatatggaaccaaaaatgagcccgcattgccaagtcaatgctaagccaaaagaacaaagctggaggcgtcgtgctacctgacttcaaactacactataaggctacagtaaccaaaagagcatggtactggtaccaaaacagagatatagaccaatggaacagaacagagccctcagaaataataccacacatctacaaccatctgatctttgacaaacctgacaaaaacaagaaatggggaaagattccctatttaataaatggtgctggggaaactggctagccatatgtagaaagctgaaactggatgccttccttataccttatacaaaaattaattcaagatggattaaagacttaaatgttagacctaaaaccataaaaaccctagaagaaaacctaggcaataccattcaggacatagacatgggcaaggacttcatgtctaaaacatcaaaagcaatggcaacaaaagccaaaattgacaaatgggatctaattaaactaaagaacttctgcacagcaaaagaaactaccatcagaatgaacaggcaacctacagaatgggagaaaaattttgcaatctactcatctgacaatgggctaatatccagaatctacaaagaacttaaacaaatttacaagaaaaaaacaaacaatcccatcaaaaagtgggcaaatatgaacagacacttctcaaaagaagacatttatgcagccaacggacacatgaaaaaatgctcatcatcactggccatcagagaaatgcaaatcaaaaacacaatgagataccacctcacaccagttagaatggcaatcattaaaaagtcaggaaacaacaggtgctggagaggatgtggagaaataggaacacttttatactgttggtggaactgtaaacaagttcaaccattgtggaagacggtgtagcgattcctcagggatctagaactagaaataccatttgacccagccatcccattactgggtatatacccaaaggattataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtaggcacctggatgaagctggaaaccatcattctcagcaaactattgcaaggacgaaaaaccaaacaccgcatgttctcactcataggtgggaattgaacaatgagaacacttggacacaaaaagggaacatcacgtactggggcctgtcgtggggtggggggaagggggagggatagcattgggagatatatctaatgtaaatgacgagttaatgggtgcagcacaccagcatggcacatgtatacatatgtaacaaacctgcacattgtgcacatgtaccctagaacttaaagtataataataaaaaaaagacaaagcacataatcctaccaaaaaaaatctctacacttccttataagtatttcagc

SEQ ID NO: 26 - DNA, 10854 bp, Homo sapiens
gcattatttcctaactctagtttttttgttcaacttctgtgttaattttccattccaacttttatttacttatttttaaatttttaatttttgtaggtacataggaggtgtatatagttatggggtacatgagatattttgatacaggcctataatgcataacaatgtcatcaggattaatggggtatccatcacctcaagcatttatcctttctttgttttacaaacaatccacacatattctttcagttattttataatgtacaattaattattcttaactatagtcactctggtgtgctattaaatactagatcttattcattacatctaactgtatttttatgcccattaactgtccccattccacccaccctactacccttcccagcttctggtaaccatcattctatctctacttccatgaattcaactgttttaattttcagctcctataaatgagtgagaataagcaaagtttgtctttctgtgtctgccttatttcacttaacataatgacttccaattccagccatgttgttgcaaatgacaggatctcattctttttctgtggctgaatagtatttcattgtgtatatgtaccacattttctttattcattcattcatttgttgatggacacttaggttactttcaaatcttggctatggtgaatattgccacaataaacataggagcacagatatatcttcaacagactgattgcctttactttgggtatgtccttagcagtgggaatgctggatcatatggtagtttttgtagatatttgaggaacatccaagctgttgtccatagtggttgtcctaatctacattcctaccaacaatgccaatgtcaaattatactacagagatatagtaaccaaaacaacatagtactgtcataaaaacagacatctacagatgtctctatatctgtgccagcatttgtttttgcctgtctctgataatagccattttaaatagggtgagatggtatctcaatgtagctttgatttatgtttttctgatgataaattatattgagcacattttcatatatatgttttccatgtatatgtcttcttttgagaagtgttcattcagaacttttgcccattttctaatcaaattattagattttttcctatagagttgtttgagctccttatatattgtagctattaattcattgtcacatggatattttgcaaatatattatcaatttctgcaggttgtctcttcattttattgtttcctttgctgtgcagaagctctttaactttatgtgatcccatttgtctaattttgtttggttgcctgtgcttgtggagtattactcaaagcttgttgcacagtccaatgtcctggagaatttccccaacgttttcttatagtagtttcatagtttgaggtattagcgttaagctgcaaatccattttgatgtgatttttctatatggtcagagatggtggtccaatatcattgctctgactgcagatacccaattttcccaacaccacttactgaagagactgtctttctccaatgcatgttcttggcacctttatcaaaaatcagttcactgtagatatatagatttggttctgagttctctattctattccattgttctatatgtctgtttttagaacagtcctatgttgttttggttactatatctctgtagtataatttgaagtcaggtaatatgattcctcctgttttgttcttcttggtcaagctgactttggctattctgggtcatttgtggttccataaaaattttaggattgttttctctatttctgtgaagaatgtcattgatattttggtagggattgcattgaatctatagattgctttgagtagtatggacattttaaaaatattaattattctaatccaggaacatatgtatttccattttttttgtatcctcttcaatttctttcatcaatgttttaagttttcattgtagagattgctcacttctttggttaagttaattcctaggtatctaattttatttctagctattgttaatgggattaatttcttgatttatttttcagattgttcactgttggcatacagaaatgctactggtttttctatgttgattttgtatcctgcaactatactgaatttattcatctgttctcaatttttttggtgggatttttgggtgttttcaaatataagattataccatctgcaaacaaagataatttgacttattcctttccaatttgaatgccctttatttctttcttttgcctgattgctctagctaggacttcaagtactatgttgaataacagtgatgaaagtggacatccttgttgtgttccagatcttagagaaaagccagttttttcctattcagtctgaatctagctgtaggtctttagtacacagcttttattttgttgaggtatgttcattctatatctagtttatttaggtttttatcataaagggatattggattgtgtcaaatgctttttcagtatcaattaaaataattatataatttttgtccttcaattctgttaatataatgcaccacattgattgatttatgtacgttgaaccatccttgcattcctgggataaattccacttggtggtgatgaatgctctttttaatgtgttgttgattttggtttgctgttattttgttgaggatttttgcatcaatgtttatcagggattctggaatgtagttttctgtttttgacctgtctttttctgattcttttatcaggataatactggccttgtagaatgagattggaagtattccttactcctctatttttgggaacagtttgaataggattggtgttagttcttctttaattgtttagtaaaactcatcagtgaagccatcaggtcctgatgttttctttgctaggagacttcctattacagcttcgatcttattacttgtttttgctctgtttaggttttggatcgtttcacggttcaatcttagtaagttgtatgtgtataaggatttattcattttttctaggttttccaatttatttgcatatagtttctcatcgtatcaactaataatctttcggatttctgtggtattgcttgtgatgtctctactatcatctctgattttgctgatttgggtcttctctctttttttcttggataatctggctaagggtttgttgattatatttatcttttaaccaccaatttttcatttcattggtcttttgtattattcacctcatttcaatttcatttatttctgctctgatctttattacgatcttgtcttctactaattttgggttccatttgcttttgcttttctagttctttaagatgcattgttaggttgtttaaagattttttaatatatctgatattggtgcttatagctataaatttacctcttagtagtgctctcactgtattttataatatttggtaggttctgcttccattatcattcgtttaaagaaatttttaaatttccttcataatctgctcattgacccactggtcattcaggagcatattgtttaatttccatgtgtttgtatagtttccaaaattcctctggttgatttctagttttattccattgtcatcagaggagacacttgatataatttcaattattaaaaaaattttaagacttgttttgttgtctaatatatggtctatccctgagaatgatctatgtgctgagaagaagcatgtgtattcagcagccactggatgaaatgctctgtaaatatctattaggtctatttggtctataatgtagtctaagtccagtgtttctttgttgattgtttttgtctgagtgatctctccaatactgaaagtggggtgctgaggtctccagctattttggttttgtggtctagctccctctttttctctaataatatttgctttatatatttgggtgctccagtgttgggtgcatatatatttaaaattgttatatccccttgctgaattgacctctgtaccattatataataaccttctttgcctccgtttatagtttttgtattgaaatgtatcatgtctggtataagtattcctgatcctttttagtttgcattggcatggaatatctttttccattccttattttcagtccatgtgtgtctttataggtgaagtgtatttcttactggtaaccaatcattgagtcttgttttttcatccattcagccactctatgcttttgattggagaggttagtctatttacattcaatgttattgttgataggtaagattttactcttgccattttgttatttgttttctagttgatttgtgatcttctcttctttctttcctgtcttccttttagtggtatgttttaatttcttggtttttgtgtgtgtatctgctgtattttttttatttgaagataccatgacccttgcaaatgatattctataactcattattttaaactgatgacttaataatgattgtataaacaaaaaaagagaattgtaataaaaattcgacactggacttcatccttctgctttttaactttttgttgcttctatttacatcttagtatgctgtctatgtcttgaaaagttgttgtagttattatttttgaatagttatcttctaggttgtttttactcaagatatgactagtttagacaccacaattacagtgttaaaatattctgtgtttttctgtgtacttactattaccactgagttttgtattatcagatgatttcttattgctcattaacttccttttctttctggttgaagtactccttttagcagttctggtaggcaagtctggtattgatgaaatccctcagtttttgtttgtatggaaaattatatcttcttcctatatgaaggatatttttactggacatactattctaggatacagctttttttccttcagcactttaaatatatcctgccattctctcctggcctaaaagttttccactgcaaagtctgttgccagatatattggagctccatgtatgtgaattgtttcttttctcttgctgctttcaggaatttttctttatctttgacttttaggtgtttgattattaaataccttgaggttggcttctttgggttaaatctctttggtgtacaatagctttcttgtacttagatattgacatctttctctaggtttgggaagttctctgtttttatctcatttttttgtctcctctgtatgttttgtgatggcatgtcttaaagctcactaattcttacttctacttcattaattcttctggtaagagaccgatttactcttcagtatctcaattgcatttttcaactccagagtttttgcttcattctttttaattattcaatatgtttgctaaattgatctcataggattctggactccatctctatgttatcttgaatatctttgagttccctcaagaaggctattttaaatcatctgtctgaaagttcacatatgtctctctcaacaggattagtccctggttcattatttaggttgtttggtgaggtcatgttttcctggatagtcttgatgcttgtgaatgtttatcagtgtctggccactgaagaattgggtatttattggactctttgcagtctgaggttgtttgtatgtgtgcttcttgggaaggtttttcagatatttaaaggaatttgggtgttgtgatctaagtttttgatctctgtagtcatatatacattagggggcaacccaagcccagtaatgctgtggctcttaaagattcatacaggtacttccacgaaattcttcttggatagttctggaagaattatctggattgcaaagcaaaaacgcttgttctcttcctactttcccctggataaacagtctctctctgtgatgagctacatatagttgaggaagggtggcataagcatccctgtggccaccaccactggaactgtgctaggtcagatctaaagccagcacagaactggatctcaaccaagtctttcagtaaccactgccttgctattttctatgttcactcgagcctgcagagctttaaaatcagcagttggtgaagccagccaggcttgttttcttttcttcagtgtggcaagttccccttggtcccaggtaggtcaagagatgccatccaagagccagcaccttgagtcagttactttaggaatctacctgtcacccaagccacaaaacaaagtccttccctacttccctcctctacccacaagcagagaagtctctccctgtaactatcaccaccccagttatgtggtgagtgagtattacctggttacctctgatgtttattcaaggacccagggctctttagttagcttgtggtaaatgctgccaggcctaggactctcccttcagtgaagtgagctcccctctggaccagagagggtacagcaatgccatctcagagccaagaccaaagcctggaatctgagacccttggtgctctactctgtttgggccaagctggtacctaatctgcaagatgaagtcaccttttctctccctccatttttcctcgagaagaaggagtccctagctatagccaccacagctggaaatgtgcagggtcacatctgaagccagtatgtctctcagtctcaaccaaggcccaccatgagtactgcctgggtaccactgctgattattcagtacctaagggatctttagctaggagataatgaatccttccaggactgggtctttctcttcaagacagtggattctcttctggcccagggtatgtctagaaatgttgtccaagagctaggtcctggaataggggcctcaggactctgcctcatgcccacttctactgtgggtgaacatgtatcaaagttgcccccccaccaaaaaaaagtcctccttacttatctctctcttctcttcaaacagaaggcagaagtctctcttggagttgcaagctatgttgtctagtgttgggtgaggggtgatgcaaaccctcccttggctgcttctctggcatctcatttggttatgctcccctgtcaactccactgactctgagccagcccagcaccaggacttgcccacagattgcagactttgtggtctagactgcctttcaagttaatgtaggcctccccagagcactttagccccgggtaaggtggtgaggcttgttagaacttaggctctgaccactgggatgagcaacttccctatggctatggctgatctcaatgcacattccatgagcactggctgagttccaccaagtgccactttccactgtgacagggcagcactaaatttcaatgcaaagttccacaattactgtgttctcactctctcccaagtgcagattctctttccacgccatgtggccactgccagagtgtgggggaagggtgatgttggcaattaaggactggctttcctaccctcttgagtggctccttcattgatatgaagataaaaccaaatatagtgatcactcacttgatttttggttcttataaatgtgattttttttgtgccgatagttcttcaatttggtgcttctgcaaggaggatgatcagtagaggtttctattcttctacggtgcgttacctctttcaatcagtatttctacttttaagaggtattgttgtttgtttttaaataaaaatctctaaaggcccacaagagaaagcaggaaagatctaaaattgacaccctaacatcacaattaaaagaactagagaagcaagagcaaacacattcaaaagatagcagaaggcaagaaataactaagatcagagcagaactgaaggagataaagacacaaaaaacccttcaaagaatcaatgaatcctggagctggttttttgaaaagatcaacaaaattgatagaccaccagcaagactaatacagaagaaaagaaagaagaatcaaatagacacaataaaatatgataatggagatattaccaccacagaaatacaaactaccatcaaagaatactataaacatctctactcaaataaactagatatctagaagaaatggataaattcctggacacatacaccctcccaagactaaaccaggaggaagctgaatccctgaatagaccaataacaggctctgaaattgaggtaataattaatagcctacagaccaaaaaaagtccaggaccagacagattcacagccgaattctactagacgtacaaggaggagctggtaccattccttctgaaaatattccaatcaatagaaaaagagggaatcctccctaactcatcctatgaggccagcatcatcctgataccaaagcctggcagagacacaacaaaaaaagagaattttagaccaatatccctgatgaacatcaatgcaaaattcctcgataaaatactggcaaaccgaatccagcagcacatcaaaaagcttatccaccatgatcaagtgggcttcaaccctgggattcaaggctggttcaacatatgcaaatcaataaatgtaatccagcatataaacagaaccaaagacaaaaaccacatgattatctcaacagatgcagaaaaggcctttgacaaaattcaacaacccttcatgctaagaactctcaataaattaggtattgatgagatgtatctcaaaataataaagagctatttatgacaaacccacagccaatatcatactgaatgggcaaaaactggaagcattccctttgaaaactggcacaagacagggatgccctctctcaccactcctatttaacatagtgttggaagttctggccaaagcaatcgggcaggagaaagaaataaagggtattcaattaggaaaagaggaagtcaaattgttcctgtttgcagatgaaatgactgtatatttagaaaaccccattgtctcagcacaaaatctccttaagctgataagcaacttcagcaaagtctcaggatacaaaatcaatgtgcaaatatcacaaacgttcttatgcaccaataacagacagagagccaaatcatgagtgaactcccattcacaactgcatcaaagagaataaaatacctaggaatccaacttacaagggatgtgaaggacctcttcaaggagaactacaaacgactgatcaatgaaataaaagaggacacaaacaaatggaagaacattccattctcacggataggatgaatcaatattgtgaaaatggccatattgcccaaggtaatttatagattcaatgccatccccatcaaactaccaatgactttcttggaaaaaactactttaaagttcatatggaaccaaaaatgagcccgcattgccaagtcaatgctaagccaaaagaacaaagctggaggcgtcgtgctacctgacttcaaactacactataaggctacagtaaccaaaagagcatggtactggtaccaaaacagagatatagaccaatggaacagaacagagccctcagaaataataccacacatctacaaccatctgatctttgacaaacctgacaaaaacaagaaatggggaaagattccctatttaataaatggtgctggggaaactggctagccatatgtagaaagctgaaactggatgccttccttataccttatacaaaaattaattcaagatggattaaagacttaaatgttagacctaaaaccataaaaaccctagaagaaaacctaggcaataccattcaggacatagacatgggcaaggacttcatgtctaaaacatcaaaagcaatggcaacaaaagccaaaattgacaaatgggatctaattaaactaaagaacttctgcacagcaaaagaaactaccatcagaatgaacaggcaacctacagaatgggagaaaaattttgcaatctactcatctgacaatgggctaatatccagaatctacaaagaacttaaacaaatttacaagaaaaaaacaaacaatcccatcaaaaagtgggcaaatatgaacagacacttctcaaaagaagacatttatgcagccaacggacacatgaaaaaatgctcatcatcactggccatcagagaaatgcaaatcaaaaacacaatgagataccacctcacaccagttagaatggcaatcattaaaaagtcaggaaacaacaggtgctggagaggatgtggagaaataggaacacttttatactgttggtggaactgtaaacaagttcaaccattgtggaagacggtgtagcgattcctcagggatctagaactagaaataccatttgacccagccatcccattactgggtatatacccaaaggattataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtaggcacctggatgaagctggaaaccatcattctcagcaaactattgcaaggacgaaaaaccaaacaccgcatgttctcactcataggtgggaattgaacaatgagaacacttggacacaaaaagggaacatcacgtactggggcctgtcgtggggtggggggaagggggagggatagcattgggagatatatctaatgtaaatgacgagttaatgggtgcagcacaccagcatggcacatgtatacatatgtaacaaacctgcacattgtgcacatgtaccctagaacttaaagtataataataaaaaaaagacaaagcacataatcctaccaaaaaaaatctctacacttccttataagtatttcagc

SEQ ID NO: 27 - DNA, 12639 bp, Homo sapiens
aaatctttttgaccttctcttatgttttcattatagtgactccattcttcatgactggttagctcttctgtgactgttccatgaaacatctaggaaagataagaaagtgctttgatttttttttccactttcaaaaatttacctgaaaacaaacaaaattttgccaagagatagcgcaagtaaaaagtgttattaaagttaaaatttaaaaaaactcattcttatagaactttctatcccaaaataacttaaatatctaacatttcaataacagccaatcagaatgttatcactgccctcaccagtgaacgaactaattagcaagaggaagacaaacttccattttcatagaatatttgaaaaattcagtgaagaaactgagataaaatcatcccttctagacaagacaactaacaacaaacaaatgaaaccatactttatataactcgtatgataatttttgttaaaatatactgttaaagaaatacactgaataataaacaagtcaggagagtgataatctttgttaaagaggctaaacaatgcagccagataaaataaaggtgctatacaggccttcaaatgttatcaacaatatttgtgtcttacagagaaaatttgttgtcaaaatatttacattcaattcaattaggaaattaggctcagaattctaatagctttaaattttgactacttaaatttatctaaaatatttggataaatggtttttaatataattttacacagtatttctcatatatgtgaattttcacttattaagagtaatttcagctttcataaaaggtagtcagtgataggtgagaagagaatgtatgagctgaagtggtctatttggaagtatgttttaagatcaacattccccaatggaagaatcgatttctacgatgtgcagataaactaaatcagtgtgattcaaatgagaataaatgtgaaaatccagatacactcttgtactctttcaagacactggttactttatatatcacaaccaaggcctaaaactagaatcctccagctctaagtgtcaatgaattaattagaaggcagattcatgggccccatctcatatctactgtatcagaatttctgggctaagggcataggaataatgttaacaggtgatcgacgaacaccttatgaaagattagcctcaactacaagtaaaccagtcttaaaaatatagagtcagatatggaatacacagatataaataaacctttacaaattaaactcatgaagctctattggtgctgggatgtaggataatatacacatcatttggacttccaaaatagaaaagatataagtctttcctcatttaaagaaagcttaaatttaaggttcctccaagtctttagaaaaataactcattttttaaagtactgaataacattccatcgcatggatgcactatggtttggtttatttatccattcacctattgaaaatgtcttggctgtttccaactttacacaattatgaataaaagtgctataaaaatttatgtgcaggtttttgtgtggatatgttttcaacttacttggataaataccaaggagtttgtttgctgaatcacataatatatttcattttgtaaaaaactgctactgtcttccaatgtggttgtaccatttggactcccaccagcaatgaatgagagattttattgctccacaacctcaccagtacataatgttgtcaatgttttgattttggtcatattaataggtgaataatggtatctcattgctttaatttgcaattccctaataatatatgatgttgagcatctttcatacatgtggcttattagccacatgtatatcttccttggtgagttatctgttcagatcttttgtccattatattttgattgtggtattgtgttattgttgagtttgagtactttgtattacttcagataccaatcctttgtcagatatgtgttttccaaagtttttttttcccattctgtggcttgccttttcattttcttaattttcatttcatttttagctcataaatgcataaaaagtccttgaaagggccgggcgcagtggctcacgcctgtaatcccagcactttgggaggctgaggcgggcggattaccaggtcaggagatcaagaccatcctggctaatacggtgaaaccccgtctctactaaaaatacaaaaaattagccggacgtggtggcgggcgcctgtggtcccagctactcgggaggctgaggcaggagaatggtgtgaacccaggagcgtgcactccagcctgggcgacagagcaagactacgtctcaaaaaaaaaagtccttgaaaaaccaacaccgatcaacatggaacctcagagatctcatttcttcacataatgctaaaggtggctttatactgttaatcatggcattagtacacaaattatatatatgtacacaaaattatatatataattatatttaatatatagctatataaatatatataaatatttttatttcaaaggatttatttctcacattgattattccatctcttaacagtctattttgaaatttctttatgaagatattatcttcttcctggcatttattttcagggattctcaacagtgctattaatcaaatatagttagtaatgtctatagattcatccaccaggaataattgtttattttaaaccttctgcattaatgctatctatatgccatttgaacatgccaatgaactactaatggtattattccaaagtggagttttttctattttccttactgatctcagatatattagagaattttccaaaatgagaggttctacacttgtgtgagacattcaaattttagctattagatgaataaccttgttagtagctttgtgacattaacaaatactgttgtaatgaacctgataaaataacattgtcccctcccaccaaaattcttaaatatgttcaaatatttttctacataaaatttgtaatatataataagggaattggtatgattggcactattgcctcacttgaaaacttcttgtaaataagacatagagtttgaggaagaaatgaaatattggttcacacaaatccaaatttgggataatgctcatgatattacttaattcaatgccttttttttccattttgtacaacagtttacttttcagtttcaatcaaaaagatgtctattagaaaaaaaattgtaagaattaagtactagtgtaattaaggatatattaaattcaaatttgagatctttttgatgttacttaatgcagtgtcttttcctccattttgttcaactgcctactttttagctttaatcaatgactattataagcaagaaaaaaaatcactaatcatcagggaaatgtaaattaaaaccttactcctgcaagaatggccataattaaaaagtcaaaaaacaatagatgctgtcgtggatgtggtgaaaagggaatactgctggtgggaatgtaaactagtataaccactatggaaaacagtatggaaattccttaaggaactaaaggtagaactaccatttgatccaaaaatcccactactgggtatctatccaaaggaaaataattcattatataaaaaagacacatgaacatacatgtttatagcagcacaactcacaattgcaaagatatggtacaaacctaagtacccatcaactaattagtggattaaaaaaatgtgagagagatatatagatatatatatataggtatatgtttacacacacacacacacacacacacacacaccatggaataccactcagccacaaaaaggaacaaaacaatgtcttctgcagcaacttggatgtagcccagaaggctattattcaaagtgaagtaactcaggaatggaaaaccaaatatcataagttctcacatataagtgtgagctaagctgtgaggatgcaaaggcctaagaatgatataatgtactttgaggactcaagggtgaaggttgggagggtcacgaggtatagaagactacatactgggtacagtgcacactgcttgggtgacaggtacactcaaatctcagaaatcatcactaaagaacctatccatgtaacaaaatagcacctgtaccccaacaactattgaaataaaaattaaaaaacaacaaaaaaagtcaaaaaataacagatgctggtgatgtggagaaaaaggaacgcttatacattgttggtgggagtgtaaattagttcaaccattgtggaagacagtgtggcaatttcccaaagacctaaaaacagaaacaacatttgacccagcaatcccattactgggtatatacctaaagcaataaaaattgttctattataaagacacatatacgtatgttcactgcaccactattcacaatagcaaacacatggaatcaacctaaatgcccataaatggtagactggataaagaaaatgtggtacatttacaccatggaatactatacaaccataaaaagaatgagatcatgtcctttacaggaacatggataaagctggaggatattatcctcagcaaaaaaatgcagggatagaaaaccaaatactgcattttctcccttatatgtggaagctaaattatgaaaacacatggacacataaaggggaacaacacactggggcctactagagggaggagagtgggaggagggagaggattaagaaaaataactaatgggcactaggcttaacacctgggtgactaaatcaattgtacaacaaattaccctgaaacaagattacctatgtatcaaacctgtacatctatccctgaacttaaagcaaaaatttaaaaaatccaaactattaagaaccctggcttcttagttaatgaaatgtgctaacctgctatcttaggatgttacacttctctctcagtgtaaccttctttggcaaattattgtctagtcattatttagactctgattctatccacacatccccaatttagtgattacatatttatatatgttattatttaatggccctgttttccactaaattatatgtaccctgtgaacagaaaacttgttttatggttaggtagtttttcaaatttttccataggacctgaactagaactgagtcaggtttcaataaatgtctctttcatacacatgtctgtcttttcctttcctcagagaaacagcaaactatggggaaggaacctgtaaaagacttctaagtacaaatgacaaagtctctcccatttcggtagaaatctattgtaaattcctttatttttaattctccacagccaataatcacttgcaaaacaacaaaaaaggtttatttttcaattatttatgtagtgtaacaaatcactccaaaatttattggcttaaaataaccatcattttgttactctgaagattctgtgtgttgactcagttgaagtaagcagttctccaactgacagtggctgaagcatcagttagttcactcctccagtgaactgctggaaggttaggttcagctggaatgctgagatgaaccagtctttctttccatactgtctcaggacctctctatgttgacctgtcctctccatgtcatctatccatgtgtgtctgaaatagggtagccagactttctacatgcttaagggctcccaaagcataaaagcagaacctgtccaaacttcctaaggcttaggttcaactgaagcgtctcctcagccacattctactggttacgacaagttcattttatttttcaagcaccctataaactaagtacagaaaaaggaaatgaaatgtaagttgttctgagattggtgatctcaagtaaattatgtatgctgtgcctcagtttccttatctgtaaaaagaagataataataacagcccatagaatttttatgaggacgaaataagtcaacctaaagggtttagaacagtgtttggcacttaatgatatggttgggctgtgtccccacccaaatctcatcttaattgtagctcccataatttccacttgctgtgggagagacccagtgggagataattgaatgatggtggcagttttctccataccgttcttgtggtagtgaataagtctcatgagagctgatggttttataaggggaaacccctttttctttgttctcattctctcttgtctgctgccatgtaagatgtgacttccaccttctaccacgattctgaggcctccccagccacatggaactgtgagtccactgagcctctttttctttataaattacccggtgttgagtgtgtctttatcagcagcatgaaaacagactaatacagtaagcactacaaaattaattgaatgcctagttccattaacaattcaagataaaatatatgcttcaaaaagtgtatcaagggacctgcagtttccagtatggcatgtaaggagcttggagtagtcactccatcctaacaacacattagaaagctgaacaaactaaaaatcaacaacttttcttagctacacaaagtaaggtcatagggtaaactgctgaccacaaaattggagcaacagacaggcagtacagaaactcatcaggaacagacacacagatgtcagggatgttggaaatatcagactgggaattgaaaacaactaggattaatatgctaatggctctaatagaaaaagtaggcaacatacaagaacaaatggataatgtaggtagagagatagatattctaagaaagaataaaaaagaaatggtagagaccaaaaacattataacagaaatgaagaatacctttgaagggctcattagtagatgggacatgactgataaaagaatctctgactttgaggatatgtcaacaaaaacattcaaaactaaaaaccaaagagaaaaaaaaagactgaaaaaaaacataacattccagaagtgtgggacttctaaatgtgtaacatacgtgtaataaaaatgccaaaaaaggaaaaatagaaaggaataaaagcagtatttaaaacaataatgaatgacaatttactctaacatcggacactaagccacagattcaagaaacagagaacatcatgtaggataaatgtaagaaaataaaaaaaaaacaacctcacacctagataattaatatacaaacttcagaaaatcaaaggtaaaaaaaaaatcttggaaaaagccaaagaatttttaaaaaatcttacttataaaggatcacagataataacgacatttgatttatcagaaaccatgcaggcagaagatagtggagtgaaatatttgaagtgttaagagaaaaaaaactcactgacctagaatttataaggggaaacccctttcacttggttctcattctctcttgtctgccgccatgtaagatatgccttccaccttctgtcatgatgctgaggcctccccagccacatggaactgtgagtccactaaacctctttttctttataaattacccagtgttgagtgtgtctttatcagcagcatgaaaacagactaatacagtaagctctacaaaattaattgaatgcctagttccattaacaattcgagataaaatatatgcttcaaaaactatatcaaggacactgtatggtgcaaaattattctttaaaagtgaaaaagaaataaattctgttagataaatattgaagtaatttgttgttggtaggcctgccttgtaagaaatgttaaaagaagttctgagagaagagaaatgatataggtcagatactcatatctatgttaagaaagagtgttgggaaaggaacaagtgaggataaaataaaaatctcttatttttcttattcttagttgaataatttgtccaaaataataatagcaactagttttattttaattcatccaacaacaacagaatatacattcttttcaagctcacatggagcattcactcaccaagacagaccacattctgggccataaaacatgccttatcaaattcaaaagaacagaagccatgcaacatcttctctcagaccacagtggaattaaactagatatcaataacaggcaaacagctggaaaattccaaaatacttgggagatttataaacacacttctaagtaacacataggtcaataaaaatttaaagatattttgaactaataaaaataaaatgtaaaatttagcaaaatttgtgggatatagtacaagcagtgcttaaaaggaaattcatagcactgaatacatatattagaaaagagcaaagatctaaaatgaatcatataagctgccatttctagaacttgaaaaagagcagcaaatttaatccaaagtaaatatgagaaaatttttctcatatttttcaagaaaattgtaattcttaattatattctcaaatattctgggaggaggggcatattttatcatcatctcattccagaagagtccataaagatctatagtctctataaaaaataaatactctactcagattatatgtaggttcttctacaatgtaaagcatctaaccattaacctgtagttcacatgtttagtgaagagtggggaggtctttccatatactcactgtggttacttttaccatgcaataataaatctcactccaaaatgtatcctttccttatctgttaggacattcagagttaatttttttccaacttttattttagaatcagggagtacatgtgcaggtttgttacaaaagtatattgcataatgctgcaatttggagtatgaatgaatttgtcacccaagaagtaagcatagcacccaacaggtagtttcttttcagcccttacctgtcatcctctctcccaattcttgtattcctctcaaataccaaatcttatccgaaatatgtgtctaaaaacatatttttcagttcctctttactgatttttgtttcatatgtattcaatattttaaaatcttctcaactggtttctttttagttgatgtgatatgaacactaaaataatttagtcttataagcagtcttccccatacactatattaatttacattcattttctctattaatattcacctctgccaacaatatgtatttgccagtatataaacaaccttaatatttttaaaaattacaaaacagaacataataatactggttattgctattaaaaggaaagattaacatgagtaataaattacagaaaaaactagtattctatattcagaatataacgtatgtgtcagttatttatattattcagctacatattctgtcgaactttccaatcattatggaaaagtggggatttttcatattttgttttaactaccacatgcagcatttcaattttgtttctcattatttatttatgttgtacatctgaaaactggaataactcaaatgaccaggccccagagcatgtcccctgaatcatatcattgcagctatgggcccatatgattctactgcctaccaagggaagctaaaaaccactacaattgatatatcctcctctaccaagttggaagccctttaccacttgttgcaaatttaaaatatgcacatagaggaggaatctagtcactttcattcattttagactttgataattttataactattttgtgaaatgtatatacacatttgtaaattatcaagttcaaataataatataatgttcaaaggcaaattaagtatagcaacacgttacagaacgtatcaagtctccaaccacagtttcaaagaaattctgcagttaaaaataaatcagtaccattatcagcaaacctttccttagtttgtatcaactaaagtaccaatttaaaaattatcctacattttaattgcactatataaaccatgtctataaaataaaatgcacatcagttatatctcatcttcacacccaactttgatggcaaacacattaagtgtaactatacaaggttataactcatgaatatttaaattaaatattaagaagtaaaaactatttattttgtatatttatttcttttccaaatgtgatacataataaatattgggaaaaaagttttcaaagaaagtctttgctgagtgtactaattacctttagacttaacacttattcactgaagctttcagatacttggaagacagatcatcattattttaagtaatatattaaaatattagatttgatggtctacatgaaagtaatttattttataagcatgaactataatattagatggaaatctgaatactagactccagaattatcacaacagctgttatctgcatataaaatcaaatcataaaaaaagaataaaaagtcttagtttttagaaaatctaattgtaaggattctaatcagtaacattttatacatattgtgattacaaactatttttagtttagaatgtctgcaacatattaagtgcatctctattaacaaaataaagaaattatattttttaaatactttttatttggataacagatttgttaagtaacgactgttttaataaagaattgccatgggccggtgcagtgactcatgcctgcataatcccagaactttgagaggccaaggcaagagaatgcttgagtccaggagtgagctatgatctgccattgcactccagcatgggtgaaaggttgtctctaaaaataaaaatcctgtctctaaaaatataaaagaattgccataattttatatcacagaaaaaatatattttaaaagttaagaaggggagagtctagtagaacagtcagactagtacatgtgtcctggaaaatgaacacagaatatagtgcatttataacttaatataaataaccttggtagcacaaaacattatattttcatggcatattctatatgttttcaaatgacatgaaaagtcattcagaacaaggaatcagaattcatttgtaattataactttttttctttaaatatattggctttttgaattttagaaggttatatacttctgttcagaaaaaaagcttttgtgagacctcatttttcaatttttatttttattccaacttggagactgcaaaagcataagcctgaaaaaactaaaaggtggtgagccagaagatggatattaaacagccaaaattaataaaaacattcacagaaaataatctgcacagaaatcacaacctcttaataaagaaattagcacgacaaatatttcttctagcccaaaacattccttggttagctttcatagaacagattttggatctcctaaaattaagccattaatacctttttcttaagtgtcataaatattgtattacattaattaaaatttaattcttgactctactaatttatattcttcaaccacttgccctctccctatccctttcccctccccgaaacctcatcctggtatttggacaaagtagattatgattacactactggggaactccatttggaaaaaaaatctacaaaaatactaagggaggaagtataataaaagttcaggggtgggagaatgtttctctgcactacagaaagttgaggggtgtgagggttcctccaacagggcatagtgagaaaaaaaatatttaagaaataaattgagaacaggctagctgagtaaataaatcgaaataaaacaaactgcaaaaagacaatttttgctttcgttgcatgtcaggaagggtaacaggaggaaacagtggttaaacagagccatgaagcacaaggactggaaacaagtacagccctagcttggcctgaccacagcatgcactacgagctccacagtatataatccaggaccctattcatttggcttcaacttcctcatataaagaaggggggaaaattaaaacattcttctctataatttccacacaacagtcatagttatatgcctgtagtaataaaaaaacagtgtaactggcattaactgtaaatgggttggaagacattttaatggggggatgaaaatgttctaaacctgtacctcaataaagttgctttaaaaaatctatctcattcttccttatggcagctcttcagatactctctactctcctcctggaaataaaaagcccaaatgcctccacagaatataatttttcaatttattatagtctagtatgttcaacatctttttaaaaatgtggaatccaaaactaaacagattatttcctgtgtgtttgatttgtgcagaattaatgggcttacagcttggctggattgatatattttactctggtaaaatgacattctgataaatacctggaaaaactctgtggcgaattctctagtataataatactctggtagcttaagatgttaaacagtcatatcacactgttttattatagtgaatatgaacttaaataaaatccctaaactttttttgcctccaacaatcaactgccacggaaatttactcctactcatatatatagtattttttaattttttttttactaaaaattaatattaatgaaaatttgagaaaagaaagaaaacagaagccatagctgataatatggtatatttatttccagcaaattttgattgcatgatatagtcatattgagaaaaaataatatccaatttctatggccatccttcccagatccaagaaatactctaatattctgtatgataccgtcctagatccaataaatactctatttaatattct

SEQ ID NO: 28 - DNA, 5025 bp, Homo sapiens
acccaggtttatgctgaatataagaagtatacataaaataatatgaaaaagaaaggttgaaaatgaagtgacatttaaagaggctgggcgctgtgtctcacatctgcagtctgaacactttgggaggcctaaaattactgtagatgggaggattgcttgagcccaagagtttcaaatcagcctaggcaaccaagcgagaccccgtttctataaaaaatttaaaaaacttagctggccatggtggcagcctgtggtcccagttatccagaaggctgcggtgggaggatcacttgagcctgggaggtcgaggctgcagtgaaccctgatcacgccactgcactcctgcctgggtgacagactgagaccttgtctcaatttaaaacaaataaaaaaggcaactacaggaaagttaaacaacctgttcctgaataactcctgggtaaataaagaaattaaggcagaaatcaagaagttctttgaaaccaatgagaacagagagacaatgtaccagaatctctgggacacagctaaagcagtgttaagagggaagtttatagcactaaatgcccacatcgaaaagctggaaagatctcagatcaacatcctgacatcacaattaaaagaactagagaagcggctgggcgtggtgactcatgcctgtaatcccagcactttgggaggctgaggcgggtagatcacctgaggtcaggagtttgagatgagcctgaccaacatggagaaaccccatctctactaaaaatacaaaattggctgggtgtggtggcacatgcctgtaatcccagctacttgggaggccgaggtaggagaatcacttgaacccgggaggtggaggttgtggtgagctgagattgcgccattgcactccagcctgggcaagaagagtgaaactctgtctcaaaacaaacaaacaaaaacaacaacaaggaaatagagaagcaagagcaaacaaatccaaaagctagcagaaaacaagaaataactaagatcagagcagaactgaaggagatagaaacacaaaaaaacccttcaaaaaatcagtgaatccaggagctggattttttgaaaaaattaacaaaaaatacctctagctaaactaaagaagaaaagagagaagaatcaaatagacacaataaaaaatgataaaggggatatcaccattgaccccacagaaatatacaaattactatcagagaatactataaagacctctacacaaataaactagaaaatctagaagaaacggataaattcctggacacatacaccttcccaagactaaatcaggaagaagtggaatgtctgaatagaccaataacaaattctgaaattgaggcagtaattaatagcctaccaaccacaaaaagcccaggaccagatggattcacagccaaattctaccagaggtacaaagaggagctgataccattccttctgaaactatttcataacaattgaaaaggaggaactcctccctagctcattttatgaggccggcatcatcctgataccaaaacctggcagagacacaaaaaaagaaaatttcaggccaatatccctgatgaacatcggtgcgaaaaattctcaataaaatgctggcaaaccaaatccagcagcacatcaaaaagcttatccaccatgatcaagttggcttcatccctgggatgcaaggctgattcaacatatgcaaatcagtaaacataatccgtcatataaacagaaccagtgacgaaaaccacatgattatttcagtagatgcagaaaagaccttcgataaaattcagcatcccttcatttaaaaactctcaataaactaggtattcatcaaacatatctcaataataagagctatttatgacaaacccatagccaatatcagtgggcaaaagctggaaacattccctttgaaaactggcacaagacaaggatgccctctcccatcacttctattcaacataatattggaagttctggccagggcaatcaggcaagagaaagaaatacagggtattcagatagaaagagaggaagtcaaattgtctcttgcagatggcatgattctatatttagaaaatgccatcgtctcagccccaaaaccccttacgttgataagaaactttagcaaagtctcaggatacaaaatcaatgtgcagaaatcacaagcattcctatacgccagcaatggacaagcagagagccaaatcatgaatgaacccccattcacaattgctacaaagagaataaaatacctaggaatacagtttataagggatgtgaaggacctcttcaaggagaactacaaaccactgctcaaggaagtaagagaggacacaaacaaatggaaaaatattccatcctcgtggataggaagaaccagtatcttgaaaatggccatactgcccaaagtaatctttttttttttttttttttttttttttttgagatggagtctcgctccattgcccaggctggaatgcagtggcatgatcgtggctcactgcaacctccacttcccgggttcaagcaattctcctgcctcagcctcccgagtaggtgggactacaggcatgcaccaccatgcccagctaattttttgtatttttagtagacacagggtttcgccgtgttagccaggatggtctcgatgtcctgacctcgtgatccgcctgcctcggccttccagagtgctgggattatagatgtgagccaccactcctggctgcccaaagtaattaatagatttaatgctattcccatcaaactaccattggcattcttcacagaattagaaaaaactactttaaaattcatatggaaacaaaaaagagcctgtatagccaagacaatcctaagcaaaaagaacaaagctgtaggcatcacatacctaacttcaaactatactacaaggctacagtagccaaaacaacgtggtattggtaccaaaacaggcatatagaccaatggaacagaacagagacctcagaaataacaccacacatacacaaccatctcatcattgacaaacccgacaaaagcaatggggaaaggattccctatttaataaatgatgctgggaaaactggctagccatatgcagaaaactgaaactggaccccttccttacaccttatacaaaaattaactcaagatgaattaaagacttaattgtaaaacacaaaatcgtaaaaaccctagaagaaaacctaggcagtaccattcaggacataggcgtgggcaaagacttcatgacaaaaacaccaaaagcaattgcagcaaaagccaacatggattctaattaaactaaagagtttctgctcagcaaaagaaactatcatcagagtgaacaggcaacctatagaattggataaaatttttgcagtctacccacctgacaaagatctaatatccagaatctacaaggaacttaagcagatttacaagaaaaataaaccatcagaaagtgggcaaaggatatgaacagacacttcgcaaaagaagacatttatgtctgtagtctcagctactcgagaggctgagacaggagaattgcttgacctgggaagtggaagttgcagtgagccaagattgcgccactgcactccagcctgggcgacagagtgagactttgtctcaaaaaaaaaaaaaaaaggacatttatgtagccaaaaaacatatgaaaaaacctcatcagttgggcgcggtggctcacgcctgtaatcccagcactttgggaagctgaggcagttgtggtggtgggggcctgtaatcccagctactcgggaggctgaggcaggagaatcgcttgaacctgagaggcagaggttgcgtgagctgagattgtgccattgcactccagccttagcaacaagagcaagactccgtctcaaaaaaaaacaaaacaaaaacagctaatcactgatcattagagaaatgcaaatcaaaaccacaatgagataccatctcatgcgagtcagaaatgacaattattaaaaagtcaagaaacaatagaagctggcaaggctgtggagacataggaatgcttttacactgttggtgggaacgtaagttagttcaaccattgtggaagacagagtggcaattcctcaaggatctagaaccagaaatatcatttgacccagcagtcctattactgggtatatacccaaaggaatataaatcattctctatagagacatatgcgtgtgtatatttattgcagtactcatagcaaagacatggaaccaacccaaatgcctatcagtgatagactacataaagagaatgtggtacatacgcaccatggaatactatgcagccatttaaagaatgagatcatgtcctttgaagggacaaggatgaagctggaagccatcatcctcagcaaactaacagaggaacagaaaaccaaacactgcatgttctcactcataagtgggagttgtacaataagaacacatggacatagggaggggaacaacatacaccggggcctgtcagggggttgggggcaaagagagggagagcattaggacaaatacctaatgcatgcagggcttaagacctagatgacagcggggtgcggtggttcatgcctgtaatccagcctgggtgacagagcaagactctgtctcaattaaaaagaaaaaaacaaaactagatgacggattgataagtgcagcaaaccaccacggcacatgtatacctatgtaacaaacctgcctgttctgcacatgtatcccggaactttaaaattttttgaaaattcaagttttcattaaaagaaaaaataaaaggtactaggcagctgggcgtggtggtgtgtgcctgtagtctctgctactccggaggctgaggtgggaggattgcttgagcccaggagtttgagactgcggtgagcagtggtcacaccactgtaccccagcctgggtgacagaccttgcctctaaaaataataatttgtttgaaaattgtagaaatttaaaggtactagacaaattgaaacaaaaa

SEQ ID NO: 29 - DNA, 105455 bp, Homo sapiens
aaccagtagaattctgccaaattgccaatttaagccaaaaataagccttcttttttccacctatatctgagctttttctacagataagatttgggctaatggtttgcttattgtcattgaaacttctaatgtcataggaatcactgtcacaaagggcaaaactttaagtttataagactatattgtgttttctatgatttggctttcagcagttcttcagtgacatgtgaattacaaactttgttcatgtaaggatgatacatatatatttcccttttccatctgtcattaaggtgttaaaaatattaaaattttaattctgatttgtgttctacctgaggaatagtacctctttggtagaagggaggaaataagaactcttgaatagaatattaatagaatatgatagtccttaacaatgcatgcttggtcactgaaaagctgataaaaacaagaatttacctatttatacttaattttgttttttctaatacatttctttgtaattgatataaaaattaattttggaagttcctctaatttgggttttcttttgtgtgccagaacttttaaactgtgacgagtttgtttctatttatttgtacaagtattttctggagctttgaatctgatgattgcctggtaaatgtattgcggtaacacccaatttatctgtttttccttgaatgaatagtagaagattttggatgagatttttagttgtacagactttgttctcctctgatgggagtaagaaataaaagcacagctaacttacacccgtagttcaaaaacacaagagtgagcagatttttaaaacgtcatctcgttctcgtttgtaaggaaaggagtagtttacccccactttgtgactcagtgctctctgaaatatggcataagaggaaagttattcttgcatcattcatgtccaagttgtagatacagcttaatataaaatcgggcactgaagaacatcttctttctgatgaacagctaagtggaaccaggccacccagaatcttacccgcttctcagtggctcacattgattagccttctgagtatctcatgttcaaatgggaatgatcaaggttttttcattactgttgaaaagatttctgaggagcctgtgcatgtttaccaagtgttgtatacctttaggcatttaaacctgaaagaggcaattttttttttttttttttttttttttgagactgagtcttgctctgtcgcccaggctggagtgcagtggcacaatctcagcttactgcaatctctgcctcctggattcaagggattctcctgcctcagccacccaagtagctgggattacaggcctgaggcaccacacctggctaatttttctttctttctgtccgtctttttttgttttttcgagatggagtcttgctctgtcacccaggctggagtgcagtggtgcgatcttggctcagtgcaagttccgcctcccaggttcaagcgattctgctatctcagcctcctgagcagctggggttacaggtgcacaccaccacacccagctgttttctttgtatttttagcagacacagggtttcaccatgttggccaggctggtctcgaactgctgacctcaggtgatccacccgcctcggtctcccaaagtgctgggattacagaagtgagccaccatgcctggcctcccctggctaatttttgtattttttagtagagatggggttttgccatgttggccaggctggtcttgaattcctgccctcaagtgatctgcctgtctcacccggccaggaggcaagacattatacagacccagctaaacaatgtctctgagtaagatcagagggtaggagcggatctactgactttttaaaaaattttattttcttatataaaactttaaggaggagatctaattacttttcataactttgtatataagagaggatgttttttctttataaataaaagtattggagggtcttctgctgggcactggaagcaatgctcaggccatagctactgcatgtgcctccctgtgtcttttcagggactatttcattaataggtgtttttcttctgttcagtgtttacaggcattggagtttttacatgctaatcaagtgatccacagagacatcaaaagtgacaatgtacttttgggaatggaaggatctgttaagctcagtgagtaacaaatggacaattcacaatcatttattataattttctgccttttgtttaattaaaaacttttcttgaccaatgcaaggattaataatgatttaatataggaagaggtgagacctttgaaaactgagtgatcctctgagggttttaactaatcagtgccagagaaaggactcgctggataagacattacctaataattaccactagataagacattattaggtaatgtcttgtcttgtctttttgagatggaggtttgctcttgttgcccaggctggagtgcaacctccgcctcctgggttcaagcgattctcctgcctcagcctcctgagtagctgggattacaggtgtgcaccaccacacccagctaatttttgtgtttttagtaaagacggggtttctccacattggtcaggctggtctctagctactgaactcaggtatcttcccgcctcagcctcccaaagtgctgggattacaggcgtgagccaccgcggctggccatgattgcttatttttaagtaatcttaatggggaagctctcatacatttttggtgaatacacatgaaaatgaattaaacttttggatgacattttttttttctggctctgccatttactaagtgaataaccttggataagttgtctttatgcctcagtattcctatttgtaaaatgggaataattgtaataataaatgtacctttctcatagggttaccatgcggattaaatattttaattcttataaggtacttaaacagtatctggattgttttaagtactcattttagctataaatattgtttgacctaactgttactcttgtagaattctctcctgtagaatttctgaacttacataccgcagtaagtacaaggatgttctctgcaatattgtaaagaaaaaccaaaactatcttaagtgttgagcagtaagggaataattacatggattattatatttttatattctgtatagtttttaagatgagggaggccgggtgcagtggctcacgcctgtaatcccagcactttgggaggtcgaggcaggtggattgcttgagcccaggagtttgagaccagactgagcaacatggcaagactccatctctactaaaaatacaacaattagccgggcgtggtggcaggcgcctctagtcccagctactcaggaggctgaggcaggaggatggcttgagcacaggaggcagaggttgccgtgagccgaaattgctctactgcacacagcgtgggcaacagagtgaaaccctgtgacaaaaaattttaaaataaaaaattttttaaataggcagatgtactaatatggaaagatctcaagaaatggttttaccaaagtttacagagtatcctgattggtaatacaaaccaaaccgttcatagatattattcatgcatatgtacatgcataaccaacagtctaaagcttacaaacctaaattttaacagtagtcacatatgaaatggaatgggtttaacagtataagaaagaattctaaatactaatcctgacttttccactaaatgaacattgagtactacactaggcatcctgcacctccattacaggtgagattgagaagataatgctggtggcgaccttaggctctctgctgagatgatggatgtttagtgattctggcttctgtttgttttattcaaaaatagtttacagctgggtgtgatggcgcacacttgtaatcccaacactttgggaggccaaggtgggaagatccctcccatgttgcccaggagttcaagaccagcctaggcaacacagggggactctgtctctacaaaaaattttaaaaattaaacaaaattaaaagacaaagtagtttccatgacctgacctttacctgattcactgcatttagttttggtgtctacttttgctttactttttcgtagacctctttcagttttattaaattttttaggatagaatgaattattcagaataaaaggcctcctgataatttggactctgtggcaagtaaaagtaaaatgtgagagtgtgttacatcatgaaaatatttttaaactcattctggtttactttattaatgaaatctttaaaaacaagaggcctaatagtcaaaatataattaattacataatctgaagtgaactcttctgctaaaaccatccatggaagccattaactctgttttgttttgttttgtagctgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggtaagatgagttaaacaccagccttgttcaatgtttttctttgaaactcttatttagaacttgcacgtgcctggcactgtccaagaatttaaagtagaaggttgataaaacctaatctctgcccctaactctgcatctagaaatcatttgctctctgagttacaaattaatgtgttaggtgaagactttgtaggtttttagtagtaagctgtattgttttgtattttacgtaggaagtttggagcacctgtctctaaagcttctccttcttttattttttaagatgttttgagacagggtcccactctcttgcctattctagaatgcagtggcgcaatctcagctcactgcaaccgccacctcccaggttcaagcgatcctcctacttcagcctcctgagtagctgggactatgggtgcgtgccaccacacccagctgatttttgtacttttcatagagacggggtctctccatgttgggtcaggctggtctcaaattcttgacctcagttgatccactcgcctcggcttcccaaagtgctggcattacaggtgtgaacaactgcacctggccacttctcttttttttaaattaccatatgtggctcaacattatcagttattaaggaaatgtaaatcaaaacctcaacaatcagaggctgaggcaagagaattgcttgaacccaggaggtggcagttgcggtgagccaagatagcactactgcactccagcctgggcgacagggtgagactctgtctcagcaaaaaacaacaaaaaaccccaccacaacaggataacacttcacaactactagaatggctgtactcaaaaagacaattaataaatattggtgaccgggtgcggtggcttacacctgtagtcccagcactttgggaggctggggttggaagttcaagatcagcctgaccaacatggagaaaccccatctttactgaaaatacaagattagctgagcatggtggtgggtgcctgtaatcccagctacgtgggaggctgaggcaggaggatcacttgaacccaggaggcggaggttgcagtgagccgagatcatgccatcgcactccagcctggtcgacaaagcgaaactccgtctccataaataaataaataaatgttggtgagaagataaggaaactagaaatctcgttcattgcaaaatataaaatggtacatctgctttggaaaacaacttgacaattctgtgtgaagttaatacggaattaccagatgacctagcggttcctctgctgggtacagagccaagagaattaaaatcatacatccatacagaaaccttcatgcagccacagaagtggaaataattcaaacctggtgaacagtggaatattatttggtcatagaaaggaaggaagtgccaatccgtgttacagcattgaaccttgagagtactgtgctaagtgaaagaagccgaacaacagatggcagcagattctgaccgtctgtttcctgaatgcttttcatccagttgccaaagattccagtttatgtgggccgttaaagtacttctatagaggtgattagtttagaccacttttcagaatgacattaaagccctctaatgttattcattcatttagccagtattggtttgggtacctgccatgcgctgagcactattcacaatgctgtctaaaagaacccacaaaaattcctgctcttacagaacttgtcttctagtgggaaaagagaaaaacaaaataaatcagaataatgtgtcatacattgaataatggactcttgagtactgagactggcaggaaggaggttagggtgtttactttcaaaaggtgcttagagagctgggcacagtggctcacgcctgtcatcccagcattttgggaggccaaggtgggaggattgcttgagcctaggagttcaaggccagcctaggcaacatagtgagtccccatctctacaaaaaaatttaaaaattagccaagcatgttagtgtgtgcctgtagtcacagctaattggaaccatcatcctgccccagtgcgtgggtcacttgggcccaaggaagatgaggctgcagtgagctgttatcacatcactgcactccagcttgggtgacggctaggacctgtctcaaaaaaaatacaataaaaataaaatgtaaaattaaatcaaaagcgtgcatagggagggcttccctgaggtgacatttggacacaggaagtaagagcgtgatacttacctgagggaaaagcattctaagcagaaggcacagcaagtgcaaaagctctaaagcaggagcgttccttgtgtattgagagatgattctggacctcagcacagctggcgtacgctgagcaaacagcgagaggtgcggtcgatcggcgaagaaaccaggccagaccgtagtgccttatgagagctctggaaggattctggcttttactggaggccaaatggggaaactgttagagagatctgagcagagaagcaaagtggtctccttcagttttaataggatttccctggctgcgttgttgagagatccctgaggaaggcaaaggcagagcagaagaccagtcaagaggctgatgtcataattcaggcaagcagtgatgatggcctagaccagggcagtatcagtggaggtgggaaaaagtggtgtgagtctggatgtattttgaaagaagagtctacatgagagagaaaagactaacgggatctgttcccaagtaactcaactgcattcctgtacaaagctgaagagtcttacagggctgcgtctatagccaggagtacgctcaggcttcagaagaggctcgcctccagtggccttcactgtggcaaaaaggtctacttgaacctcagtgagatcggtaaaatcaccagcgccaagctcctatcagcagatccagaagctgatcaaagatgggctgatcatctgcaagcctgtgactatccattcccaggctggatccccgcaaacaaacaaacaaacaaacaaacaaaaaaaacaccttgggccgggcacggtggctcatgcttgtaatctcagcactttgggaggccgaggtgggcagatcacttgaggtcaggagttcatgaccagcctaacatgatgaaacctcgtctctactaaaaatacaaaaatgagccaggcatggtggcgtgcacctgtattcccagctactcgagaggctgaggtgggagaattgcttgaaactgggcgacagggagagattctgtcgcaaaaaaaaaaaaaaagaaaaaaacaccttggcccacaggcatatgggcataactgctaatgcacacattaccaaaaaggcagcctggatgaggaagatgagaattccaccccagctgctcagaagacactatgaatctaccgagattgaccttcacgtgtatcagagcctgtacatgaagtgaagggggacgtgttcagaaacaagcaggttcttcggaactcattccaagctgaagatagacaaggcctcaagaagcttctcattgaccaggccagggcacatggctctaagaccaggaaagcactgtagttccacggagagtgcctctgggccaagagaaaatcattaagactgtcccaggaggaagaaactaagaaataaaggtctccctctctcgtctgtacatagtggatcttggtgattacatagatccagtcattcaaatacaacaagattttatctgcctgatggggggaaaaagcatattggtaggaatacagaaatagccaggacccagcaatcacccagacatcagtcaaagtttaccagacaggcaaaggagcaggcagatgcagcccataatgagaaaaacttccaggcaactggaacggacagaagttcattaaaacaatctcacgactgcatttcagttgtaagaactttaaatgcatattgcttagtgaaagaatccagtctaaaaaggctacatattatttcaactgtagagagtaaaaatgattagtggttatggggtttggcaggggatcgggggtagagaggatgagtaggtgaagcacagggaatttttttgggcagtgaaattactttgtatgatattataatggcggacactggagagcattcatttgtcaaagcccatggaacaactaggcacggtggtgcacacctgtagtccctgctgcttgaaaggctgaagcaggaggatctcttgaccccaggagttcaaggccagcctgggcaacatatcgagaatgcattaaaaaaaaaaacaagaccataggactgtgtaatgtaatacagagtgaaccctaatgtaaactgagggctttaatttaatagaagtgtatcaatattggttcatttgtaacaaatgtcccatagtataataatgtagacaataataaaactccacattggggaggttgcgtgtgggaactctgtactatctgttcaattttctgtaaacctaaaacttctaaaaaattagtcagttaaaaataataatttaggaccagacgcagcggctcatgcctgtaataccagcactttgggaggccaaggtgggcagatcgcttgaggttaggagtttgagaccagcctggccaatgtggtgaaaccccacctctactaaaaatacaaaaattagtcaggcgtaatggtgcatgcctgtactcccagctactcgggaggctgagctgcaagaattgctggaacccgggaggcagaggttgccatgtgttgagatcatgccactgcattccagcctgggcaacagagcgagactgtgtctgaaaagaaaaataaataggccagatgcagtggctcacacctgtaatcccagcactttgggaggccaaggcgggcagatcacaaagttgggagtttaagaccagcctggccaacacagtgaaaccccgtctctactgaaaatacaaaaaattagccgggcattttggcgggcgcctataatcccagctactcggaaggctgaggcaggagaatcgcttgaactcaggaggtgaaggttgcatcgagctgagatcgtgccattgcattccagcctgggccacagagccagactccgtctcaaaaataaataataaataaataaataaataaaattcaatttatagaaatgtaaaggaaataattagaactatgtaaggattttctaaagggagttgattaaattaggaaacattcatataaggcaatatttacttaagccattacagtaattttatagatctaggtagttattagtaatgatgacctgggataatttgtttttttggtttttatttttgagacagagtcttgctgtcttgtccaggctggagttacagtggtgcaatcttggctcactgcaacctccacctcccatattcaagcagttctcctgcctcagcctcccgagtagctggaactacaggcatgtgccaccacacccagctaattgttttttttttgtatttttagtagcgatggggttttgccatgttgcccagcctggtctcgagctcctgagcccaggcaatccacttgtctcagcatcccagagtgctaggattacaggcatcagccaccatgcccagcctaatttgtttttgtttgtttgtttgtttgtttatttttgggacggagtctcgctctgtcgcccaggctggagtgcagtggcgcaatctcggctcactgcaagctctgcctcccgggttcacgtcattgtcctgcctcagcctcccgagtagctgggactacaggcgcccaccaccacgcccggctaattttttgtattttttagtagagacagggtttcaccatgttagtcaggatgctctcaatctcctgacctcgtgaccggcccgccttagcctcccaaagtactgggattacaggcgtgagccaccatgcccggccttggtttttttttgttttgttttttgttttttaagttttaacaaatctcattttttttaatgatatgtatgacttgaaaaaaatttgagaaacctaaacaggatggtcaatggtgaggttgtggttatttttaattattaacattgttttattttttaaagcaatatgggctgggcacagtggctcacacctgcaatccagcactttgggaggccgaggcaggtggatcatttgaggtcaggagttcaagaccagcctgaccaatatgatgaaaccccacctctactaaaaatacaaagattagcaggtcatggtggtatgcatctgtaatcccagctactcgggaggctgaggcaggaaagtcacttgaacccaggaggcagaggttgcagtgagccaagattgcaccactgcactccagcctgggtgacagagcaagattccgtctcaacaaaaaaaaacaaaacaaaagcaatatgtattgcatttataaccgaagaaaaaccaaaggtgaatctgatttcagaaaagtaacttaaggaaatgtaacatctaaaaataagaggaaagtatcaaatctaaatttaaatgggataatgataaccccagtttagtatttatggtgattttctttaaagaagaaagaatcccttagactttatggagtgctctgtgaccgtgttgagctatcttaagtggatcaaagatgttcttctatttttaggccttgtacctaatagcaactaatggaaccccagaacttcagaatccagagaaactttccccaatatttcgggatttcttaaatcgatgtttggaaatggatgtggaaaaaaggggttcagccaaagaattattacaggtaaatttaaaaatgatttcatttgggggaatagttgacttttttggtaaccgacagaaagctttcctagggctaataagtagatttcactactcattgatcaccagcggtatggcagctgctgcaatttagggtttcatcctaccatgctgagcaaactaccgcaaggacagaaaaccaaacactgcatgttcccactcataggtgggaattgaacaatgagaacacctggacacaggaaggggaacatcacacaccggggcctgttgtggggtggggggagtggggagggatagcattaggagatatacctaatgtaaatgatgagttaacaggtgcagcacagcaacatggcacatgtgtacatatgtaacaaacctgcacgttgtgcgcatgtaccctagaacttaaagtattaaaaaaaaaagtgagggtttcatctgctgtgaataaaattctgacaaaaccgtaatgtgcagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcactcctcagacctgtttattgctgttgtgtgtatatttgtcaaactaaaatgattctgctttcattcaactctgaaagtaatgcgttgattatgttagtcttatgaaggtattaatatgtgtttagtttattaaattatgatcgacaagtagtctttggggcttaattgaacaaaattattttgtttctaacctgatgaatggcacttatacatttatttttccccttctttctggcagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaaccttttaatggtgttgtgccatcattttgaatttattacaaagctccaaagtaggaaggtttctagaaatgtgtgggcagtaaacatgaagttttccttttttttttttttttttttttttttgagacaagtctcactctttcttccaggctggagtgcagtggcgccatctcagctcactgcaacctctgcctcccaggttcaagtgattctcctgcttcggcctcctgagtagttaggggaagttttccctttctaaatcaagttcagaataattttctttatcaatgtttctctatcagacccagggaaacagttctgatttgaacacacaccttgctggagtaataaaaacctgatcagaatttctgtgttaagtgaaccaagaaaccttttagagtgcaatacgtcgtaaggcatcacttcattatgtgaattaatttggaatcttaggtaccctaacatagggaacagccacaataatggtttactatcaaaaagcataaaataaggccaggcgtggtggctcacacctgtaatcctagcactgggaggctgagactggcggattgcctgagctcaggcaggagaccagcctgggcaacatgatgaaatcccatctctactaaaatacaaaaaaaaatcagccaggtgtactggcacatgtctgtagtcccagctacttgggaggctgaggcacaagaattgtttgaacccgggaggtgaaggttgcagtgagacaagatcatgccattgcactccagcctgggtgacagagcaagactcctgtctcaaaaagaaaaaaaaaaaaaaaaaaaaaaaaaaaaaaaaaaatatatatatatatatatatattctgggtgagaaggggaggcaatgactttgaaatgtatttgttacactatatggctgtttcgtcttgttctaacatttatatttctttgaactaatagcaaatgctcaaagcattgcctaagaaaacttttaaaagcctgtggttaatttcagaagctctatctctagggcttggcgggaggatggctcgagcctgggaggcagaggttgcagtgagccaagatggtgccgctgtactccagcctgggtgacagagcaaggcccctgtctcaaaaaaaaaagagttggtaattgcctatatctctataaagagaattttatagtctcaataatcctgattatagctgttttacccatacatcttagtttggggttagggaaaaagactaaaaatgctgcatttctgggaaacaatttgttcagaaaatgacagcatttatataaacttgtgagttacgtgaagagactgctgatcttcgccgggcgcggtggctcccgcctgtaatcccagcgctttgggaggccgaggcgggcggatcacgaggtcaggagatcgagaccatcctggctaacgtggtgaaaccccgtctctactgaaaatacaaaaaattagccgggcgtggtggcaggcgcctgtagtcccagctactcgggaggctgaggctggagaatggcgtgaacccaggaggcggaggttgcagtgagccgagatcgcgccattgccctccagcctgggcgacagagcgagactccgtctcaaaaaaaaaaaaaagagactcctgatcttgaaaggaatgacgcccgtggatacgtcatctctggatagttgttagaaggtgcccgttgcattccctcgttcatccgtcccagtttgctctggagcagatgcaaacgtctcaccctcgtagtgctgtaacaggccagatagagtgacagtgccagatagagtgacagtgccatacatttctgtttttcattcttagacctgtaggtatgtacagcacagcatcatcaacgcgttgccaaaaaactattttcctccaattcttaataaactacttcactttgacttctatatttaaaatagaagtatagggccaggcgcagtggctcacacctgtaatcccagcactttgggaggccgaggtgggtgtatctatcacctgagggcaggagttttaagaccagcctggccaacatggtgaaaccccgtctctacttaaaatagaaaatgagccgggcatggtggcgggcgcctgtaatcccagctactcaagaggctgaggcaggagaatcgcttgaacccgggaggcagagattgcagtgagccaaaatcacaccattgcactacagctttttgagactccgtctcaataaaatagaagtgtaccattttcaaaacctagttgatcacggccataaaattaagtaatatctaacagtacaatccaactgtgattgctttaatatattgtcagtaaaatctttaaggagtttcaggattgaaactagaagacatcttagtcacattcaatattccttacattttagtacactttacgatttgctgctagtatctttgttgagctgtttttcagtaaactaaaaatcttaatcatttgaggttttagtatagatactgtcactgttttgttcacactcttggtgctgtaggagtgtaaatgaccatctcatttgttcatctgttcatgctctattggagcatgccgtaagactgtggtgtcattgaaagtgacctttggccatggactgttggatatgtggatcagctactttcatataacttgcattgtcagcaaatacttttccacttcccttcagccctgcgtattttaccacggataaacggtgttccattatgcgcctgctctgtcccatttccgtagtgtcttttttttatgacaaagcacagctggtcaaggtgttatcatgggtctgagtgcacgagtgtttgttgctgcacgttccccatccagtcactaagcaagacacagaactgtatgaaagcttatttttacttagtttcatcttagagtcacatttgaacttgtgagtttcttttaaatgaaactgtgtttaattttgagatttgctgctagggggaggactccttacgctttttgaagttagtaacagccctctctagtagaatgtgcacaaaaacggttaatgtgaattggtgggcttgtttctgtgctttgttttgagtgataatacaagggcctacatcatagggggttttcagggttaaattcattcatttcaaataaaatatttagaatgatgtctagcacaaagtcaacatttgataaatgtagtctcctctcattgcttttttcccctctgatattgcgggagcagatgcagaagtaacaggatgctgcacagagctatttgcacttttctcccatctctcgtatttaaaaaatggatgcattatggaaattatgctgcaaatattacacagcttttttttttttttttctaacacaggatctcactctgtcgcccaggctggagtgcagtggcacaatctcggctctctgcaatctctgcctcctggattcaagcgattctcctgcctcagcctctgagtagttgggactacaggcacgtgccattaccgcccagctaattttttgtattttaagtagaggcggggtttcaccatgttggccaggctggtgttgaactcttgacctcaagtgatccacccgcctcagcctcccaaagtactgggattacaggcgtgagccaccacgtctggctgttccacagctttacacaaagaaggcccccagtacatccctatttggtcacacagtgtgaaattgtgtattttacagtattgcatagttggcaatatgagactgtgcattgtagtttggataatcacttccctgaagggatattgcagataaaaaagtttaatttgagaattggttcttgaagtttttgtttgttgttttttgagacagagtctcactctgtcacccaggctggaacgcagtggcatgatctctgctcactgcaacctccgcctcccggattcaaacaattctcctacctcggcctcccaggtagctgagactacaggagtgagccaccacacccagctaatttctgtattttaagtagaagcaaggtttcaccttgttggccaggctggtcttgaactcctgacctcaagtgatccaccacctcagcctcccaaaatgctgggattacaggcgtgagccaccacacccagctgttacagagctttacacaaagaaggcccccagtacatccctatttggccacacattgtgaaattgtgtattttacagtattgcatagctggcaatatgagactgtgcattgtagtttggataatcactttcctgaagagagattgcaaagaaaaaaatttaattcaagaattggtttttgaagtttttgtttgtttgttgttttaaatagagacaaggtctcactatgttgcccaggctggtctcaaactcctgaactcaagtgatcctcccgcctcggcctcccaaagtgctaggattacaggtatgagcgaccacacccagccaagaattgttttatgtatctattagaaataagtttgtaaaccacaggttccaaagtgttagtacctttaatgtaacaggaagttcagtgtttgtcagtctggggttgtcctgggacaaccagggagtccagcaaccccaccagcacttgggactccacgttgtcactctatcattcttagcatgtaggcctgtatccttaatgcctgttgcaacatagatactagatggctggtgcacctccaacctcttgtccgggtgtcaagcaggagaaagagagatggcaaaaggcaacgtggaaagcacaagggagtagtgcttatatcgagagaacacaaattttcccagaaaccctcaacttctgtcccactggccagaactgtcatttggcacctcatagctgcaagagagtctagggaagagtgtttctccagataaaatgagactcgttagtgaagaaggagggatggaaatagtatataattgtgactactatagtttgagtgtgaaaattgctctattggaatttttttgtagctcttcccctactatttctacagagcactgccccgtctgttgactcctttgatactacatggttgatggggtgctcacttttagatatgagaaaaggggctagagcattaatctcttcagtgttatccaggtagaatttcagctcttctgggttaaggaactggaaacttttcaactctctaggcctcatctcagctagagagctagttttgaagaaacgtaattgcttatgaagtcataaatgcagtttaaatgtaattggcagtgttgcaagtttagtgatccatcgtgggaggagaccacaagtatctgctacaaattcctgattgagcaattgattgatttagtttagcaggagcctaggtgaccctgagcaaatagtccttcatgggtgttcctggcccctaagtgtcctctagggggtgctgctcccactgtcatgctcctcaaagatggagcctgccagaggtgaaagcccaattcctgccattgccctgctatcctcgggtttatgtcccattctggaagaactcaaatgtaacattattcaatgttacaagcagtctcactgttcagaaacatggagttcttttggttcttgagtcaaacttggtatcagcaaagctacattctcatagggagagaaaacaagtctgggtgtctccccaacttcctagtgctccagagagcctggctccctgtaataattcttattcttaaaaaaaaagtaactacataatagagaaatacattctgatttataaaatttcagccattcagacaaaagaaagcctcttcaatcccagtccaagtccccgttccaaaggaaatctcttactagtttccatcttttcagacctttctctttgcattatacctagatactggtcagttttgtagaccaagcagttcttgaaggctgcaatcaaagacaatttatgtttgtttccctctcttctaacccattttacaggggtagttcttccccattccctggatgaaatttagagcaaacacccaggcagttttaccaatgagttctaagaatattcaaagaaaaaattccaatcctgcacaaagtatttgaggatatagaaaacattccccaaattctattataaggatggagtagccatgataccaaaataattgaagaagaaaattataggataggccaggcgcagtggctcacaactataatcccagcactttgggaggctgaggcaggtggatcacctgaggtcaggagtttaagaccagcctggccaacatggtgaaactccctctctttagctgggcatggtggcatgcacctataatcccagctactcaggaggctgagacaggagaatcactttaacccaggaggtagaggttgcagtgagccgagatcgtgccgttgcactccagcctgggcaacaagagtaaaactccgtctcaaaaaaaaaaaaaaaaagtataggataatctcataaatacaaatgtgcaattattaaatatattactagcaaaccgaatctagcaatgtatgaaagaggtagtgcatcctaaacaagtaggcttatgcatgtaaaaatcaagataatttacagtattagtagattatctgggcatctcaacagattaaagagagtggctgagcccagtggttcacacctgtaatcccagcactctgagaggacaacacaggagaatcacttgaggccaggctcaagaccagcatgggcaacatagtgagaccctgtctctaaaaaacctaataaaaaaacattagccaggtatggtagcacacctatagtcctggctactctggaggctgagctaggagaatggcttgagcccaggagttcaaggttgcagtgacctgtgattgcaccattgcactccagcccacatgacagagtgacactgtctcttaaaaaaaaaaaaaaaaaagcattggctgggcacggtggctcacgcctgtaatcccagcactttaggaggccgaggtgggtggatcacctgaggtaaggagttcgagaccagcctgaccaacatggtgaaaccctgtatctactaaaaatacaaaaattagccgggcatggtggcatgtacctgtaatcccagctactcgggaggctgaagcagcagaatcacttgaacctgggaggcagaggttgcagtgagctgagacctctccattgcactccagcttcggcaaaaagagcaaaactccatctcaaaaaaaaaaaaagcatttagtaaaattcagtatcaattcatgattaaaaatatatattttagcaaattaggagtgaactttttttttccgagatagagtcttgctctgttgcccagactgcagtgcagtggcatgatctcagctcactgcaacctccgcctcccaggttcaagcaattctcctccctcagcctcccgagtagctgggattacaggtgtgagccaccacacctggctaatttttgtattcttagtagagacggggtttcaccatgttggccaggctggtcttgaactcctgacctcaggtgatccacgtgcctcggcctccgaaagttctgggattacagtgaagccactgtgccagccaggagtgaactgaatcacttgaacccgggaggctgaggttgtggtgagccgagatcacaccattgcactccagcctgggcaacaagagcgaaactccatctcaaaaaaaaaaaaaagaatttgaaagcaatggctgggcacaatgactcacggctataatcccagcactttgggaggccgaggcaggtggatcacctgaggtcaggagtttgagatcagcctggccaacatggtgaaacctggtctctactaaaaatacaaaattacccgggcgtggtggtgggcacctgtaatcctggaggctgaggcaggagaatcacttgaacctgggaggtggaggttttagtgagccgagatcacgccactgcactccagactgggcaacagagtgagacttggtctcgaaaaaaaaaaaaaaaaaaggaattggaaagcaagataaaatctcattattttcagataaggttgatatgataaactattaaaattaagaaatttagcaagtttgctgtatgcaaaatcagtgtgcaagagtctattatattgctaagcactagcaacaaatagaacacataatcttaaaaatctaccatttataacagatcaaaaatacaaagtacctagaaatggtcactcctgtaatcccagcactttggatcacctgaggtcaggagttccagaccagcctggccaacatggtgaaaccccatctctacaaaaatacaaaaattagttgggcatggtggcgtgcgcctgtaatcccagctactcaggaggctgaggcaggagaattgcttgaacccaggaggcagaggttgcagtgagccgagatcgcaccattgcactccagcctggggtgatggagtgagactctgtctcaaaaaataaataaataaacaaaaagggaggattttactgaaagattttaaatgttggattggaaactattttatggatagttgaaattgcacttcaaaagagaaacaatttaattcaatttaagccagataaatgaaacattggttcaaagtcagaaatacatagtcctctaaattttagtataaagagacactttacagaagccataaagtagcctgtagaggccagcaccggggcttatgcctgtaatcccagcactgtgggaggctgaggtgggtggatcacctgaggtcaggagttcaagaccagcctgggcaacatggtgaaaccctgtttctactaaaaatacaaaattagccgggtgtggtggcgcactcctatagtcccagctacttgggaggcttaggcaggagaatcgcttgaacccaggaggtggaagttgcagtgagctgagatcatgccattgcactccagcctgggcacaaagagtgaaactccatctcaaaataataataataataataataataataataataataatattcaaaaaggagaatagttgggaagcctataaatttcagcctatcctaattcagggatcctgcttctaggaggaagaaaaaaaggcatccaatagagatgaatgaacgttgtataccccctttgcctccttttcaggataatttagtgcaaactttaatactcgccattcagatgctcttcagtcataactcctaaacatgctgagggcctgttgtgtgtctgaattagtggatagggaaatgaggcacaaaaggcaattttgaagactggcctctttcagaattgcagagtttggtggactttatttttttctttttttggggggtggggggcgcaatctcactctgtcacccaggctggagtgcagtggtgtaatcggctcactgcaagctccgcctcccaggttcaagcgattctcctgcctcagcctccccagtagctggactacaggcgcccaccaccatgcctggctaatttttgtattttcagtagagacgtttcagcatattggccaggctggtcttggactcctgaccttgtgatccgtccgccacagcctcccaaagtgctgggattacaggtgtgagcccctgcacctggcctttggtagactttatattgaggagcttttgtggctgagtaaactctggacttttggaaggagaagaggtagaaaggtgttcatggaaagggacccaatcccccaggagagggttcttggacctcatgcaagaaataattccaggggagtccacggagtaaactgaaagcaagtttattaagaaagtaaaggaatagggccgggcggggtggctcacacctgtaatcccagcactttgggaggccgaggcaggcggatcaccaggtcaagagatcgagaccatcctgccaacatggtgaaaccccatctttactaaaaatacaaaaattagctgggagtgttggcatgcgcctgtaatcccagctactcgggaggctgaggtaggagaatcacttaaacccgggagcagaggttgcagggagccgagactgtgccattgagctcctcctgcctgggccacaagagcaaaactccgtctcaaaaaaaaaggaaaagaaaggaatagagcacgtctgctccataggcagcgcggcagcttgggctgcttgactgaatatacttacagttatgctaaacaaggggtggattgttcatgagttttccaggaagggggtgagcaattcccggaactgaggattcctcccctttttagaccatacagtgtaatttcctgacgttgccatgtcatttgtaaactgtcatggtgctggcgggagtgtccttcagcagctaatgcattataattagcgtctaatgaacagtgaggaccaccagaggtcacctcattgccgtcttggttttggtgggttttggctggcttggtaacacatcttgttttatcagcagggtctttatgacctgtatcttgtgctgacctccaggcctcagccttattttaaccagtccttattcaagatggagtcactccggttcaaacacctctgacaaagggataaagaaaaacgtggtctgcagattgttgcaaatgaacctaagccaggtttgatcatgcctcatttttgtttggttgtttttttcctttttttttttttttttgagacagggtttcacactgtcactcgggctggagtgcagtggtgcgatctcagctcactgtaaactccacctcccaggctcaagtgatcctaacacctcagcctctcaagtagggactacagccaccacacccggctaatttttgtgtttttttgtagacgggtttcaccatgtgacccaggctggtcttgaacccctagcctcaagtgatccaccgcttcaaccttctaaagtgcttggattacaggtgtgagccacctcacccggacatgcttaggttgtttctgtaaagttatagctacctatggagtttgaggtggtgagggttaactaacttctgacaacccccctgccagattataatgaaagcaagtcgcagaccaaatcttgtcacacacctgaaagctcatttaagcaaacatttgtcagcaaaagtgtttgttcagcctatcctgtagctcactataatccatgctctctgtcccaaatgctctgtccacaactttgcatgaaaagttcacttgaggcagagagggaaacgtgccaggggccaggattctgttacccttaaagatggcatcatgtaaccagacatcctcttaactagtggctggtcacaggattatgtaacgatggagccctgagggccattcctaaggggtcgcgttgctgacctcactagattcttacaccttgtttatgcaaaggcagcaggagtctctcaaataactttagccaatggaaggatcccgaacacctttcatttcactgatgagagcccactgatgacctcattaccaattaacaagcaactcagttcatcaggaaacagccatttctttttccatttatttatttatttatcgagacagtgtctagctctgctgcctaggctggagggcagtggtgtgatcatggctcactatagctttgacctcctgggctcaagcaatccttccagttcagcttcctgagtaactgggagcagagatgctcgccactacagctggctactttttttattttttgtacggatggggtctcactatgttgcccaggcttgtgactgcacaatgggttccccttgcccgttgcctaggcagaactgatacctcacgacaggggaactgcagtacagaaagagtaattcacgcagagccggctgtacaggagatcgcggttttattattattcaaatcagtctctccaggcattgggggatcagtgtttttaaggataatttggtgggtgggggaaggccagtgagagagtgttgattggttgggccggagaggaaatcatgggaaattgaagctgtcttcttgcgctgagtcagttcctgggtcggggccacaagatcagatgagccagtttatccatctgggtggtgccagctgatccatcaagtgtggagtctgcaaagtatctcaagcgctgatcttaggagcagtgtagggagggtcagaatcttgtagcctccagctgcatggctcctaaaccatcatttctaatcttgtgactaatgttagtctagtcccccggcaagaaggaggtctgctttgggaaagggctgttaccgtctttgttttaaactataaattaagtttccccccaagttagttcagcctacgcccaggaatgaacaagggcagcttggaggttagacgcaagatggagtcggttaggtcggatctctttcactgactcagttacaattttgcaatagcggtttcaggctgatctcaaactcctaggctcaagtgatcctcccgcctcggcctcccaaagtgttgggattacaggtgtgaacccccacacccagccaaaaaatctatttctgatcatcactcagcttgttaactgagcctcaggcgttgattgagatgtagataatagaaatgcttgcagtactgcactccagtctggaacaacagagcaagaccctatctcttaaaaaaaaaaaaaaagtgccagtagtagctgcctctagtgtgtaagtaacctttctgactagacactggctacccttatgtgtgaattttctttctttcttttttttttttgagacggagttttgctcttgttgcccaggctggagtgcaatggtgtgatcttggctcaccacaacctctgcttcccaggttcaggcaattctcctgcctcagcctcctcaaggctcacttgaacccgagtagctgggattacaggcatgccggctaattttgtacttttagtagagatggggtttctccatgttggtcaggctggtctcaaactcctgacctcagatgatccacctgcctcggcctcccaaagtgctggaattccaggtgtgagccaccgtgcccggccttcttcttctttttttttttttaagacagagtctcgctctgttgcccaggctggagtgcagtgacacaatctcagctcactgcaacctctgcctcccaggttcaagcaatttccagcgaatttttgtatttttggtagagacagggtttcactatgttggccaggctggtctcaaactcctgacctcaagtgacccagccaccttggcctcccaaagtgttaggattagaggcgcgagccactgcgcccggcctgaattttctaataaaacaatgcacgccatctttgctaaaatcttttaaagtaaattgcaggcatcataatagaagttggttcttaatatttgtagtttaactgcttattagcagtaatttgtagttgcttgtaattttactaaggtaggaatttaattttgtgacctagaagattgatgggtaggaaggaggatcacttggcttagtaaatgaagttagccagtcactcttcatccaaactttcttcttggcatttaagcactaattcccattaatgttcaacttaaattttcagttgaactttagtgattttttgggggggaacattatgttatttagggctatttgggaatttatgatggtatcaggatgtcacaggtttattgtgccataaaattttgcctatggcagactgtgcctccagtcttagtcccagaagttaagtcaggtgtctttacctctaagattccagtttaaaaaagaaagaaaaaataaataagatacaatacaggccgggcgcagtggctcacacctgtaataccagcactttgggaggccgaggcaggatgatcacaaggtcaggagatcgagaccatcctgactaacacggtgaaaccctgtctctactaaaaatacaaaaatattagttgggcgtggtggcgggcgcctgtagtcccagctactcaggaggctgaggcaggagaatggtgtgaacctgggaagcagagcttgcagtaagctgagatcacaccgctgcactccagcctgggcaacagggcgagactccgtctcaaaaaaaaaaaaagatacaatacagttccaatttagagctgggcattgtggttcacacctgtaatcccagctacttgggaggccgaggcaggaagggaggattgcttacacccaagagttagagaccaatgtaagcaacaaattgagatgcctgtctctaacgacaacaaaaaaatccagttcagtatggctaaattatacagtccatgtcctgtgatgcttacatgagttcttggggtcacgacattagccccattaaatgttccacaaggccatgagcattttttcgaagacaaaatattttaaggactagagtctttaaaggatttttggctctgtcagtctcacgctgtcacccaggctggactgcaggggcacaatctcggctcactgcaacctccgccttccgggttcaagtgattctcctgcctcagcctcccgagtagctgggattacaggcacctgccaccatgcccagctaactgttttttagtagagacggggtttcaccacattgaccaggttggtgtggaactcctgacctcaagttatcctcctacctcggcctcccaaagcgctgggattacagatgtgagccacggcgtctggactgtttgtaaactttttgccaacattttggatgaacgctgcttattcctgtgaatcaaggggtgatctcctgcagcctggaagaaacaaaaagggatgggtagtaaaaatctggatcaatatactagttccggacaattatcctgcaaattctgccaggtaatgaaagtgagtagggtctccataacctggaggtttctttgttttggaaaataaaaccaagtaacttcataacccccaggggaaaatttttatatcttggcaagtaaaattttagatggaaataatctactatgccacccttgcaggaattgctattctcactctactatttgtagtagagctatataacagtagcactttctaattgaattttttttttgagacgttgtcttgctctgttgcccaggctggagtgcagtggcacaatcttggctcactgcaacctctgtctcccaggttcaagtgattctcctgcctcagcctcctgagtagctgggatcacaggcacctgccaccacgcctggctaatttttgtatttttagtagagacgaggttttaccatgttggccaggctggtctcaaactcctgacctcaagtgatctgcccaccttggcctcccaaagtgctgggattacaggtgtgagccaccatgcccagccatgttttgctcaattattatacctatagcagggataatagttaccaacaaaaaggaagcatgaaaattttactatcactgagtctgctagaacttcttattgggtttggtaatatgtcacaccctggctatgcaaagaaggttataaaagaaagagattttatgtaagaaaggaccttgtatggtaaatactcgtcctaaaaagaatagttggttgtttttgttttgttttgttttttgagacagagtcttgctatgttgcccaggcttaagtgcactggcacaatctcagctcactgcaacctccacctcccaggttcaggcgattctgctgcctcagcctcccaagtagctgggattacaggcgtgtgccaccatgcccagctaatttttttttttttttttttttagtagaaatagggtttcaccatattggccaggctggtcttgaactcctgatctcaagtaatacacccgcctcagcctcccaaagtgctaggattataggtgtgagccactacacctggcctcgttgtttaaaaaaaaggatgttcaagacaagtcggaaagtttaagcatgtcttagatggtctgtggaagtcatgaagggattcataatttaggaattatgcaggaaagatttagccaaagttaacactaaagttaccctagccacccaaatccagtgccacttatcctaaaaggaatgttacttttattttgttatttttactttttggccaggcacagtggctcacgcctgtaaccccaacactttgggaggccaaggtgggcagatcacttgaggtcaggattttgagaccatcctggccagcatggtgaaaccccatctctactaaaaatttaaaaattacctgggcatggtggcatgtgcccataatcccagctacttgggaggctgaggcaggagaattgcttgaacctgggaggtggaggttgcagtgagctgagattgcaccactacacaccagcccaggcaacagagcaaaactccatctcaaaaaaaaaaaaaaaaaagaaaaagaaaaaggaatgttgcttttatattaacatttcagcaacatctggtggaggcaagccagtgttagaacccatcagagtggctgacagcagtcaaactccaaacgctgcttcagacagaaccacgcatggacacgcctttcttccgaggacccttagattggccccaggaggagccctagctgctgttccccacgcagtgccccttttcagcaagaagcagccggaaagagtctttatccaacacccgctaacaatagttagggttacaccactccagagcgggggaatgatacaggagttaagaagaaattacttaggcagatagtgagggtatggaagtcttcagtaaggttttccttttagtgaaaaacagccccaaatcattttcctttctaacaaagaacagcctgtaaaattgagctgcagacatacatgccagcagttgtgccaatcatgttcgagatggcggctccctcttcccttctctgccagccacgtgtacagtaaggagcagacaagatggcactggccaaggggacagttcgcttgcataatgagattagggtggggcggccagccttccccgcacattgtgtaaatatcatacctaattgaaccaatctgtgagccccatgtaaatcagacaccccctcctcaagccagactataaaatccagcacatctgctgctggccagacttttcctctcgttaagtcccctctctctcactagagagagagctgttttattttctctttcttttgcctattaaacctctgctcattcacttaaggtgcttagcacagtgtctgtaaatagaaatccctcaaaacatattcgttattatttttaactttattttaagataatgttatttatttatttatttattttattttattttatttttttttgagtttcactcttgtcacccaggctggagtgcaatggcgtgatctcggctcactgcaacctccacctcctgggttcaagcgattctcctgcctcagcctcacgagtagctgggactacaggtgcccaccaccacccagctaatttttgtatttttagtagagatggggtttcaccatgttggccaggctggtgtcgaactcctgacctcaggggatcctcccgcctctgcctcccaaaatgcagagattacaggcgtgagctaacatgcccggtcaagagaagagttaactcttaaaaagactgttatcatgtcagataagaacagcaactttgtagctttctgaaccctctcaacttgccatgcagaataccacagccttaccagatggacatggcagatgaaggagttcaaaacagtggagcagctagaaacttaaaggatcaattctagaaatgagaaagtcacagttgggttggattcaaaatctgagtataaactctgcctaaattcctggctggctggccatactacaaaatgtacacaggagctccagggacccctacaaaatggcaaggaggaactgagtgggggccaggggtgggggcacccgggatcctacctcaaagacagaagtgatcctggtgagatttatgagttttatactgagtctgttcctcaacccacacacaattcaggtggcaaaaagtgaaagcattattggcttgaagggtcctgagacagaacttggggctcataagacaacatgaaatgtagagggtgtgccccatgcacaatctgttacccctcagctcgaaatctattattctttgccctgtaaggcataagaagaggtaggttcgcttcctggttcctgtgtactttcttcccctgtgatatgactcccagaagcactcaggaggatcagtggtgcttattctctctctctcttttttttttgacatggagtctcgctctgtcgcccaggctggagtgcggtggcgtgatctcagcttactggaacctccacctcccaggttcaagtgattctcctgcctcagcctcctgagtagctgggattacagtcacgtgccaccacgcctgcctaatttttttgtatttttagtggaaacaaggtttcaccgtgttagccaggatggtatcgaactcctgacctcgtgatccatctgcctcagcctcccaaagtgctgggattacaggcgtgagccactgcacctagcctttttttttttttcgacagagttttgctctgtcacccaggctggattgcagtggcacaatcttggctgactgcagcctccgccttccaggttcaagcaattctcctgcctcagtctcccaagtagctgagattacaggcgtctgccaccacacctagctaattttggtatttttagtagagacgggtttttgccatgttggccaggctggtctcgaactcctgacctcaggtgatccacccgcctcagcctcccaaagtgttgggattacaggcgtgagccagtgttgggattacaggcatgagccaccacacccagccctagacagggtaattatgtaagaaaaagaaataaaaaatatccatattgaagagaaagaaataaaactttgtcaattaacagacggcatgaccttgtatgaagaaaatcatggctgggcacagtggctcatgcttgtaaatcccagcactttgggaggctgaggtgggagaatcatttgaacccaggagttcaagaccagcctgggcaacatagggagaccccatctctactgaatgaatgaaagaatgaatgaaggagcaagccaggtgtagtggtgcacgtctgtagtccccgctactcagaaggctgaggtgggaggatctcttaagacccggaagttgaggctgcagtaagccacaatccacagtcccacgctgcactccagcctgggtgacagagcaggactctacctaaaaatatatatatatataagtaaagaaaatcctaaggaatccacgcacatacaaaaatattacaactaataaatgatttcagcgaggtttgaggacacaagatcaataaacaaaaagctacaataatcaagagtgtggtactaacataaaaatagacatataggccaggtgcgatggctcacgcttgtaatcccagcactttgggaggccgaggtgggcagatcacctgaggtcaggagtttgagaccagtctggccaacatggcgaaaatccgtctctactaaaaatataaaaattagccgggagtggtggcgggtgcctgtgatcccagctacgcaggaggctgaggcaggagaatcgcttgaacctgggaggcggaggttgcagtgagtggagattgtgccattgcgctccagcctgggcaacagagcaagactctgtctcaaaaaaaaaaaaaaaaaaagaaagaaagaaacaaaagtgttttcaacaaatggtgctgggacaaccgaatattcatatgcaaaagaatgaacttggacccttccttataccatctacaaacattccaaatgcatcacaggtgtacttgtaagagacaaaattagaaaacacttagaataaatcataggagtaaaccttcatgacctccagtgaggcaatcattacttagacatgagaccgaaagcacaagggacaaaagaaaaaaatagataaattggactggacaaaatgtaaaagtcttatgctgcagataatatcattaagaaagtgaggtgtggggcgcggtggctcacgcctgtaatcccagcactttgggaggccgaggcgggcggatcacttgaggtcaggagtttgagacagcctggccaacatggtgaaacaccatctctactaaaatacaaaaattagccaggcatggtggcacacacctataatcccagctacttgggaggctgaagcacgagaattgcttgaacccgggaggtggaggttgcagtgagccgagatcatgccactcactccagcctgggtggtagagtgagactccatctcaaaataaataaatacataaataaaaataaaaaaacacagaaagggaaaaaatatttgcaactcatacatatgataaagtgtttgtatccagcatcgagaccatcctggctaacacggtgaaaccccgtctctactaaaaatgcaaaaaattagccgggcgaggtggcaggcgcctgtagtcccagctactcgggaggctaaggcaggagaatggcaggaaccccggggggtgtagcctgcagtgagccgagatcgcgccactgcactccagcctgggcgacagcgagactccgtctcaaaaaaaaaaaaaagtatttgtatccagaatatataccaatatgagttgatgtattgatatataccaatattgaccaatatgtatctagaatatatatcagttagttttttaaaagttggcttcagaattgtttataacaatgttgaatactaaatgattatgttaatgcctttataatatttaatattttatataaataaaataaaatgtagtgtcattctagaattctgtacccaggaaaatcattgttcacatacaaaggcaggcaggccacaaacattttccaaatatgtaagcatggagagaaggttgttctcatgatactttctctaaaagttttcaaagagtagcattttccaatagaactttctgcaatgatggaaatatctgtatcttcaccctccattatggtgaaatcttcaaccccacgtagttagctattaagcatctaaaatgtcactagtgcaactggagaactgaattttattaattttatcaacttgttaattgattaataagttaaattaattttattaagtttatttttattttactttatttgagacagggtctcgttctgtcacccacgctggagtgccatggcctcaacttcccaggctcaagcaagccttccacttcagcctccctagtagctgggacttacaggtgtgtgcctggctaatttttgtattttttgtagagacaaagtttcatcatgttgcccacagtggtctcgaactcctgggctcaagccatccgcccacccccaccttccaaagtgttgcgattacaggcgtcagccatcgccttatttattttattttatttttttttttttgagagggagtctcgctctgtcgcccaggctggagtgcagtggcatgatcttggctcattgcaagctccgcctcccgggttcacgccattctcctgcctcagcctcccgagtagctgggactacaggtgcccgccaacacgcccggctaattttttgtgtttttttcagtagagatggggtttcaccttgttagccagatggtcttgatctcctgacctcgtgatccgcccgcctgggccttccaaagtgctgggattacaggcgtgagccagcgcgtccagccaatcgccttatttttaagtttaaatagctatgcatggatatcttttttatagtgtagagtatttcacactgaagagaaggtaaaatagttccttccttccttccttccttccttcctttctttcttctttatctctttctttctttctctttctttctttctttttaaatttgagacagggttttgttctgtcacccaggccggagtgtagtggcacagtcctagctcacttcgtctccaactcctagtctcaggcgatcctcctgcatcagcttcccagatagctaggactacaggtacacccaaccacatccagctaattttttttttttcccagacggagtcttgctctctcacccaggctggagtgtaatggcgtgatcacggctcactgcaacctccgccttccaggttcaagtgattctcccgcctcagcctcctgagtcgctgagattacaggcgcctgccaccacgcccagctaattttttgtattttcagtagagactgggtttcaccatgttggccaggctggtctcgaactcctgaattcatgattcgcccgccttagcctcccaaagttctgggattacaggcgtgagccattgcgcctggtctaatttttaaaatatgttttagatttgggggattgggagggtctctctatgtttcctgggctggtctccaactcctggcctcaagcaatccccctgcttaggcctcataaaatgcttggattgaaggcatgagccactgtgcccagcccaaaacagcactttttttttttttgagacggagtctcgctctgtcgcccaggtgggagtgcagtggtgcaatctcggctcactgcaatctctgactcctggattcaagtgattctcccacctcagtctcctgagtagctgggaaaataggcgtacgccaccacgcccagctaatttttgtatttttggtagagatgtgatttcaaccatgttggccaggttggtcttgaactcctgacctcaagtgatctggccaccttggcctcccaaagtgctaggattacaggcatgagccaccacaccagcttacccagcattctctacagtcacaccccctatgggggagatgaaagggaaaaaagacaaaaaaaaaattataggagtccgggtgcagtggctcacacctgtaatcccagcactctgagaggccgaggcaggtagatcacttgaggtcaggggttggagatcagcctggccaacctggtgaaaccctgtatctactaaaaatacaaaaattagctgggcatggcggtatgtgcctgtaattccagctagtcgggaggctgaggcaggagaatcgcttgaacccaggaggcggaggttgcagtgagctgaggtcacaccactgcactccagcctgggccacagagactcaaaaaaaaattatagggaaaaaaagaaaaaattctaccagcattaaaataattataaaatgtatatttttgagacagggtcttactctgttgcccaggttacaatgctatgatgtgatgatcatggctcactgcagcctaaacctccccaggctcaggtgattctcacctcagcctcctgggtagcttagcctcccgggcagcctcccaggtagctgggactacaggcatgcatcaccatgcctggctaatttttgtatgtttgtagagacagggttttgccatgttgctcaggccagtcttgaactcctgagctcaagtgattcacccacctcaacctcccaaagtgctggaattacaggcatgatccaccatgcctggcctccatacatccatattaaccttgaacgtaaatagtccgaatgccccacttaaaaggcacagggtgtcaagttggattaaaaaaaacactacctatccatctactgtcttcaagagacccatctcacatgtagtgacacccatatgctcagagtaaagcattggagagagatctagccacaaacagaacacaagaaagagcagggtcactattcttaatcagataaagcagactttaaaccaacaacaataaaaatggacaaagaaaggcattatgcagtgataaagaattcaattcaataagaagacaaatatcctaaatatatttatacccaatattggatcacccagatttatgagtccttctagacctatgaaaagactttgaaagccacacaataatagtagggtacttcaacacctgactgacactgctagaccgatcattgaggcagaaaactgacaaaaataggctgggcacagtggctcatgcctgtaatcccagcactttgggaggctgaggtgggcagatcacttgaggccaggagttcgagaccagtctggccaacatggtgaaaccctatctctgttttgtaaaatacaaaaattaggtgggcatggtggtgcacgcctgtgttcccagctactcaggaggctgaggcaggagaatcgcttgagctgggaggtagaggttgcagtgagctaagattgcgctactgcactccagcctggatgaaagagcgagactctgtctcagacaaaagaaaaagaaaaaggaaggaaggaaagaaaagaaagaggaaggaaggaaggaagggagaaagaagaaagaaagctgacaaaaattctggacttaaattcaacacttgaccaattggacctaatagacatctacagaatactccacccatcaaccacaggaatatacatttttctcatctgcacatagaacacattccaccacatgcctggccataaagcaagtttcgataaatttaaaaaaacctaaatcatagcaaccatattctcagacctcggtagaataaaaatggaaatcaataccaagaagatctctttaaaccacacagttacatggaaattaaacaacttgctcctaaaagacttttgggtaaatagtgcaattaaggcagaagtaaaaaaatctttgaaataaatgaaaacagagacataacatacggaaatctctgggatacagcaaaagcagtgttaagagaaaagtttatggtgctaaacacctacctcaaaaagttagaaagatctcaaattaatgaggtaacatcccacctagaggaactgcaattattggggaacctgccctgatagtcacgtaagttcttttctattttccctaaacatccgctggtttgagaaataaagggacagagtacaaagagagaaattttaaagccgggcatctgggggagacatcacatgtcggtaggttccacgatgccccacaagctgcaaaaccagcaagtttttattagggagtttcaaaaggggagggagtgtgcgaataggtgtgggtcacagatcacgtctttcatgaggtaatagaatatcacaaggcaaatggaggcagggcgagatcacatgaccacaggactggggtgaaattaaaattgctaatgaagtttcgggcaccattgtcattgataacatcttatcaggagacagggttttgagatcaaccggtctgaccaaatttattaggggggaatttcctcttcctaataagcctgggagtgctatgggagactggggtttatttcatccctacagtctcgaccacagaagatggccacacccaagggggccatttatagacccaccctcaggggtgcattctctttctcagggatgttccttgctgagaaaaagaattcagcaatatttctcccatttgcttttgaaagaagagaaatatggctcttttccgcccgtctcaccggtggtcagagtttaaggttatcgctgttattccctgaacaattgctgttatcctgttcttttttcaaggtgcccagatttcatattgttcaaacacacatgttctacaatttgtgcagttaacgcaattatcacagggtcctgaggcgacatacatcctccttggtttacgagctgacaggattaacagattaaagtaaagacaggcataggaaatcataagggtattgattggggaagtgataagtgtccatgaaatcttcagagattgcagtaaagacaggcataagaaattataaaagtattaatttgggaaactaataaatgtccatgaaatcttcacaatccacgttcttctgccatggcttcagcgggtccctccgtttggggtccctgacttcccgcaacacaatggccccaaagctagcaggagaaaagaaataattaaaatcagagcagaactgaatgaaattgggacacaaacatccatacaaaaaatcaatgaaaccaaaagttggttttctgagaggataaacaagatcgataggccactagctagattaacaaagaaaaaaagaggctgggtgtggtggctcatgcctgtaaccccagcactttgggaggccgaggcaagtggatcacttgaggtcaggggttcgagaccagcctggccaacatggtgaaaccccgtctctactaaaaatacaaaaattagctgggtgtggtggcgcacgcctgtaatcccagccacttgggaggctgaggcaggagaatcacttgaacctgggaggtggaggttgtggtgagccaagattgcaccactgctcttcagcgtgggcagcagagtgagactgtatctaaaataaataaataaataaataataaaaataataataataaaaaaatttaaaaaacgaagaaaaaaaagacagaatatccaaataagcacaatcagaaatgacattacaacaagtccacagtgatttaaaaaagatcctcaagatgaacacctctatggacacaaacttgaaaatctgaaggaaatggataaattcctggaaacacacaatctgccaattttgaagcaggaagaaattgaaaccctgaacagaccaatatcaagttatgattctgaatcattaaaaggagtctaccaaccaagaaaagcccctgatcagatggattcacagctgaattctactacatgtacaaagactaagactaatcctcctgtattagtccgttctcacactgctataaaggcatacccaagactgggtaatttataaagaaaagaggtttaattgactcacagttctgcaaggctggggaagccttaggaaacttatagcagaaggagaagcagacacatcttacatggtggcaggagagagagaatgaatgcaagcataggagaaactgccacttttaaaaccagaaatcagatcaggctgggcacagtggttcatgcctatcatcccagcactttgggaggctgaggtgggtggatcacctgaggtcagaagttcaagaccagcctggccaacatggtgaaaccctgtctctacaaaagtacaaaaattagccagacgtggtgatgcatgcctgtgatcccagctacttgagaggctgaagcgggagaattgcttgaacctgggaggcacaggttgcagtgagctgagatcatgccattgcactccaccctgggcaacagaacaagactccatctcaaaaagaaataaaaataaataaataaataaataaaaccatcagatctcatgagactcattattgggagaacagcatggggggaactgcccccataatccaatcacttccctcccttgacacatggggattaaaattcaaaatgagatttgggtggggacacagagccaaaccacatcacctactaaaactattcccaaaaaattgaggagagacccctccctaactcattctaggaagccagtatcaccctgatcccaaaacctggcaaaaacaatgaaaaaataaaactgctgggtatggtggctcacgcttgtaatccctgcactttgggagaactgagggaggtggatccttgaggtcaggagttcgagaccagcctggccaacatggtgaaacctcatctctactaaaaatacaaaaattagccgggtgtggtggtgcatgcctatagttccagctacttgggaggctgaggcaggagaatcgctcgcacttgggaggtggaggttgcagtgagcccagatcgcagcactgcactccagcctgggagacagagtgagactgtctaaaaaaaaaaaaaaaaaaaaaaaaaaaaaaaaagaaagaaagaaaagaaaactacaggccaatatccctgatgaaaatggatgcaataatcttcaacaaaatactagcaaactgaatccagcagcacatcaaaaagttaattcatgaggccgagataggtggatcacttgaggccagaaattcaagaccaccctggccaatatggtgaaacccatctttactaaaaatacaaaaattagctgggtgtgttggtatgtgcctgtaatcctaactattcaggaggctgaggcatgagaattgcttgaacatgggaggcggaggttgcagtgagccgagatcatgccattgcactccagactgggtgacagagtgagactctatctcaaaaaaaaaaaaaaaaaaaaaaacagatgcagtggctcatgcctgtagtcccagcactttcggaggctgaggtgggcagattacctgaggtcctaagtttgagaccagcctggccaatataatgaaaccctgtctctactaaaaatacagaaattagccaggcattgtggcccacacctgtagtcccagctactcaggaggctgaggcaggagaatcacttgaacccaagaggtggagggtgcagtgagccaagatcgcaccactgcactccagcctgggtgacagagtgagagcccatgtcaaaaaaaaaaaaaaaaaggccgggcgcggtggctcaagcctgtaatcccagcactttgggaggccgaggcaggcgatcacaaggtcaggagatcaagaccatcctggctaatgtggtgaaaccccatctctactaaaaatacaaaaaaaaaaaaaattagccgggtgtggtggagggcgcctgtagtcccagctactcgggagactgaggcaggagaatggcatgaacttgggaggtggagcttgcagtgagccgagattgcaccactgcactccagcctgggctacagagcgagactccatctgaaaaaaaaaagaaagaaagaaaaaagaaatcttagatgacaccagcaaatggaaaaacattcgatgctcatgtattggaaaaatcattatcgttaaaatggtatactgccaaaagcaatctacagattcaacattatttatttatctatttattttttggagacagagtcctctgtcacccaggctggagtgcaatggtgcaatttaggctcactgcaacctccgcctctcaggttcaagccattctcctgcctcagcctcctgagtagctgggattacagatgcctgccaccacacctgattcatttttgtattttagtagagacagggctttaccattttgcccaggctgatctcgaactcctgagctcaggtgatccgccccccttggcctcccagagtgctagtattagaggtgtgagccaccacacccagcctaaacattattcctatcaaggtactgtgtccagagttggttccttctggtgggtttgtggtctcggtgacttcaagaatgaagccgtggaccttcaccgtgtgacagctcttaaaggtggcacagacccaaagagtgagcagcagcaagatttattttgaacagtgaaagaacaaagcttccacatcgtggcaggggacccgagcgggttgccactgctggctgtggatggccagcttttattcccttattggccctcccatgttccatttctgtcctatcaaagtgcctttcttttttttttgagacggagtctcactctgtcccccaggctggagggcagtggcacgatcttggctcactgcaagctccgcctcccggattcacgccattctcctgcctcagcctcccgagtagctgggactacaggcacctgccaccacgcccggctaattttttgtatttttagtagagatggggtttcaccatgttagccaggatagtctcaatctcctgaccttgtgatccgcctgcctcagcctcccaaagtgctgggattacaggcgtgagccaccacgcctggcctcatgtacaggcttttgtgcagacctgagtttttagttcatttggataaatatcaaggagctcgactgctggattgtgtggtaagagcatgtttagttttctaaggaactgccaactctcttccaaactggctgtataccattttgcattcccaccaacaatgaatggcccttcctattgcttttcattctcaccagcatttggtgtgtaatttctgaataaaatcctttgtgttttccaagtatacagttattttgatctgaaaataataatttttcctccattctgatttctctgtctctatattctacctcttgtcaaattatattggctaacacatccagaaaaatattaagtaatagctgtaaaaatggataaactgcttttgttcttgacttcaagtttgggagcacttttatggtgcccccattaagtatgatgctgaataattttttgtatttttagtagagatggggtttcaccatgttagccaggatggtcttgatctcctgaccttctgatccgcccacttcggcctcccaaagtgctaagattatacagtgagccaccgcccagcccagagtgcacttttttcaatcctccctgcaattggctacttttaggatcctgctgattggtgcattttacagaacactgattggtgcattttacagcatgctgattggtgtgttttacagagtgctgattggtgcattttacaatcctcttgctagctacagcgtgctgattggtgcgttttacagagcgctgattggtgcattttacaatctgcttgctagctacagagcgctgattggtgcgttttacagagcactgattggtgcattttacaattctcttgctagctacaaagcattgattggcgcatttttacagagtgccgattggtgcattttacaatcctctttaaagacagaaaagttctccaagtccccactcaacccaggaagtccagctggcttcacctgtcactaccaacgtcatttttcaaggaactagaaaaaattattctaaaatctacatggaatcagaaagactctgaatagcgaaagcaatcctaagtggaaagaataaagccagaggcatcacattactggacttcaagctatactacaaggctacagtaaccaaaacagcatggtattggttaaaaaaaaaacaacacctatggtcatctgatctttggcaaggttgataataacaagcaaaggggaaagaacactgtattcaataaattgtgctaagatagttggctagctatatgcaaaagaataaaactggagccccacttttcaccgtatattaaaattaactcaaaacaaattgagaatttaaatgtaacccttcaagctataagaatcgtagaagaaatcctgggaaacaccattctggacattggctttgggaaataatttatgactaaatcctcaaaagcaattgcaacaaaaccaaaacttgacaaatgggacctaattaaagcaaagaacttctgcacagcaaaagaacctatcaacagagtaaacagacaacttacaatgggagaaaatattcataatttatgcatccaacaaaggttcaatatcagaatctataaggaacttaactgaacaaacaagaaacaaatatccccattaaaaatgggcaaatggctgggagaggcggctcacacctgtaatcccagaacttttggagcccaaggagggcagattacgaggttgggagttcaagaccagcctgtccaacatggtgaaaccccaactctattaaaaatacaaaaagtagccaggcgtggtggtgtgcgcctgtaatcccagctacttgggaggcttaggcaggagaattgcttgaacccaggacatagagggtgcagtgagccaagattgtgccattgcactccagcctgggcaatacagtaagactccatgtaaataaataaatatataaataaataaataaaataaaatgggcaaaacacataaataggaacttctcaaaagaagacatacaagtggcccacaaacatataaaaaaatgctcaacatcactaatcatcagagaaaagcaaatgaaaatcacaattagataccatctcacaccagtcggaatagctattattaaaaagccaaaaaataacatgctgttgaggctgcagagaaatgggaacacttatactctgttggtgaaaatgtaaattagttcagttactgtggaaagcagtttggagatttcttttcttttttttttcttcaagacagagtcttgctctgtcacgcatgctggagtgcagtggtacgatctcggctcactgcaacttctgcctcccagggtcaggcaattctcctgcctcagcctccagagtagctgggattacggtcacccaccaccacacccagctaatttttgtgtttttagtagagacagggtttcaccatgttggccaggctggtctcaaactcctgacctaaggtgatctgctccactcggcctcccaaagtgctgggattacaggcgtgatccactgtgcccggcctggagatttcttaaataacttaaaacagaactaccatttgatccagcaatcccattactgggtatacatccaaaagaaaataaattatcctaccaaaaaaacacatgcatttgtatgttcattgcagcactgttcacaatagcaatgacatggagtcaacctcggtgcccatcgatggtggactggataaagaaaatgtacaaacacgctatggaatacttcacagccataaaaagtatgaagtcatgtcttttgctgaaatatgaatgtagcttgaggctgttatcctaagtgaaataatgcaggaacaaaaatccaaatgctacatgctctcagttataagtagaagctaaataatgagtattcgtggatataaggatggtaacaacaggccagatgcagtggctcacgcctgtaatcccagcactttggaaggctgagatgggtggatcacgaggtcaggggtttgagaccagcctggccaacatggtgaaactctatctcttctaaaaatacaaaaattagctgggtgtggtggcggtcacctgtaataccagctacttgggaggctgaggcagaatcacttgaacctgggaggcagaggttgcagtgagccgagattgcgccattgtactccagcctgggcaacaagggcgaagcttggcctcaaaaaaaaaaaacaaacaacaacaacaaaaaaaaacaaaacctgaaaatctaatatttaaaattaagaactcaatgtatagatttaacagcagattggagattatagaagatagactcaataacctgaaaaacagaaaaccttcaaactgaataattgaaaaaaaaattgacatcacaaagtgtaaaagacacggtgaacaagatcaaataatcttacatatgggctgggtgccgtggctcatgcctgtaatcccagcactttgggaggctgaggcaggtggatcaccggaggtcaggagttgaagaccggcctgaccaacatggtgaaaccctatctctactaaaaatacaaaaattagccgggcgtggtggtgggcgcttgtaattctggctactcgataataatactattataatagtattatctacctcagtagataatactgctgaggcaggattatcgcttgaacccgggaggcagaggcagaggttgcagtgagacgagattgcgccactgcactccagcttgagcaaaaagagtgaaactctgtctcaataataataataataatcttacatatgtaattggtgtctcggagaacaggcatagagaatgcagcaaaaaccatatctgaagagataatgattgagaatttctcaaaactgatgcaagacatctacccacaaatcagagaaactcaatgatatccaagacagataaatacaaagaaaacaaagatagggcacaaaataaatggctaaaaatcactaacaggctgggtgcggtggctcacgcctgtaatcccagcactttggggggctgaggcgggcagatcacgaggtcaggagatcgagattatcctggctaacttggtgaaacccggtctctactaaagaaatacaaaaaaaattagccaagcgtggtggtggacgcctgtagtcccagctactcaggaggctgaggcaggagaatggcgtgaacccgggaggcagagcttgcagtgagccgagatggcgccactgcactgcagcctgggcgacagagcgacactcctctaaaaaaaaaaaaaaaatcactgacaaagagaaactgttaaaaagaagtgagagggcctggtgtggtggttcacgcctgtaattcgagcactgtgggaggcccaggtgggaggatcacttgagctcaggggttcaagaccagcctgggcaacatagggagatgtcatcgctacaaaaataatgatagtaatagtaataaaaaattagccgggcgtggtgcaggagcctgtggtcgcaggtaccctggaagatgaggtgggaggatcgcttgagcccaggaggcagaggttacagcgagcctagggtgtgccacggcactccggcttgggcgagacagcaagaccctgtttggaaaaaaaaaaaaaagaaaagaaaaaagaaaaaaaaatcaacagtaattgcagccattgcttagaactaagactaaacaaagcttttgtttggaaaggagtactttttcattaacattgtttagaattttctgacacatgatgataattaaaagcaaaccatcctgcagttggcttcggtattgtttttatcttctccaccatcaatgcatatccttactgcctacacaggctctcagcaacgcactgttggttttccattgcagtcacctccactttattcttccagatcgagtatgttcaaaactgaactcatcttccgccataaatctgctattattatgtttttgcctgtcaggacatcggcttataattttggaaagcattcacagttggggcgggtaagacatagataaagaggccaatcacaataccaggggtaagatcaataggaaaaccagagagcggacgcctgggccaggcctcacaacgtccagagctggaatgggtcttttgctttcggcgcaggggtgacgggatcagcggagggtaggggtgtacactagctgcggtctgatttagcccttttaggttaaaagctggagaaggggctgaagtctcaaacgcgcttagcagctcctgaacgcggttcccatcccagcgcgttctgagggaggccggggctaaggacgcggtgacgggcgggggcggggcggccccgggtcgggaggcggggcgggagcgccggaagcgggcggtgccaggcccagcctcgcaggcggaagggcgcggaggaggtgacgcgataggccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcaggtaagcggggacgcgggcagacgagtgacggactcagcgatcgcctggcggggctggctggggccattcccgcgccggtgcgccacctcagcgcccggtccggaggcctcgagccgccctcccccgcccgagctggaggccgccgtccgtctcggccacagcctccctttccgggggaggcgagcgagctcgtcccgaggggccgctgccctgcgctctcgctccagccgggctgtgcgtcgcaggcaccgggaagctggcgccccccagctcctcctgaagccgggaaagctctgagaggaggagccgctgtcacaggcctccagctccggccgccgtggaagtccggggtttttatttgcttagaccgctctgcctccttccggccttcgtttctttcctcgcgctccccgggacccttttccagagagcccggttgggcatgagcgcggtgggagacgtcttttcccttcggtctgctctgagcggtatcagcctccgctctacgccctgtggccactctgtcggggtggagggatgcggagaggatgtgggagttttggacttagagcgagaatagccgaggtgaaatcctaccctgctctctggtagtgtttttcatctcatgctagatagacatttcgacctttttcaccgcaggtaaagtgggactttcttctaccaatgtaaattataatgtttggagaattaaatgaagaaagcagacgttagttatgaaatgttttgagaatctggttaaatttaatttaagaatatccaggacacttcatgataggttcctacttatgttttttttttgcattttgcccggaataactaagcttggtatggaaaaggttgcctagagatgccaggcgctcgtgtggtcagagcctaactgcagtctctgttttgggtgggcagcatcaggaagaaaccagactctctcctagccatccacatgtctcacgcttattgatggcatattattggtatatgagggatggcttatatcagttttgatctttactcaagatagctttttcccagtgcatcttttctaggagaaaagcttggtatgtagaggagggtgctggggaggggggcttcatttacacctgggctcacaatttttttttggaggggggacagggtctcactctgacacccagcctggagtgcagtggcgcgatcttttcagctcactgcaacctcctcctcccaggttcaagcgattctcctgcctcagcctccagagtagctgggattacaggtgcccgccatcgcgcccggctaatttttgtatttttagtagacatggggtttcaccatgttggccaggctggtctcgacctcctgacctcaagtgatctacctgcttccgcctctcaaaagtgctgggatcagccgggcgcggtggttgacgcctgtaatcccagcactttgggaggccgaggcgggcagatcacctgaggtcgggagttcgagatcagcctaaccaacatggtgaaaccccatctctactaaaaatacaaaattagccaggcgtggtggcgcatgcctgtaatcccagctactcggaaggctgaggcaggagactagcttgaacccgggaggcgaggttgtggtgagctgagatagtgccattacactccagcctgggcaacaagagcaaaactccgtctcaaaaaaaaaaaaaaaaaaaaaaaaaggtgctgggattacaggagtgagtcactgcgcctgggctatattactttctaaatcagcctttttttttttttttggtaggccattatgtgaatccttcaaaaatcatagaaaaattgaaatttaacaatattttgcttttattctagcttgtcataaacccagtgctctatacacaggcctgcctttctgcctccttcatcctggcatgcatggccatttactttgtgttattagccagcttcctatggagctcagtttgagaacggggttctgtgcttctctagttgccaaacatctgattgaagtagatcaccttggcatttgcgatattaagcatgtctttgcgaatttttagttcctttttcttttcttggttagattgtactctgtcactgatttaaagaatttggtagacgctcagaaagggtcaactggtaaggtggtcacagtgctttacatgtatttttcttacctattatggtgaaacccttgtgactttttttgggcgtgggtaatattttcaaaattaaggtaaataggccatcaggctgcgttgaactttctcttttagggaaatatattcattctccaattattctttggtagccttcttattgctttagcaattcctactctattattagtagagccggaaatggaccctacatcacagattctccaaatatactaaattattttttctctaaaatgatcatgtttatagcatgttgattttctttttttttcttttgagacagagtttcactcttgtgcaggctggagggcaacagcttgatctctgctcactgcaacttccgcctcccgggttcaagtgattgtcctgtctcagcctcccaagtagctgggattacaagcgcccaccaccacgcccggctaatttttgtatttttagtagagatggggtttcaccatgttggccaggctggtcttgaactcctgacctcaagtgatctctccgtctcagcctcccaaagcgcggggattacaggtgtgagccactgtatccggtcagcagcatgttgattttctacaaccagatgacaaaggatatcctaaagtcagtgatttaaaaagtcatgttggcttggtgcggtggctcatgcctgtaatcccagcactttgggaggccgaggcgggtggatcacgagtcaggagttagagaacagcctggccaacatggtgaaactccgtctgtactgaaaatacaaaaaaattagctgggcatggtggcgggcgcctataatcccagctactcgggaggctgaggcaggagaatcgtttgaacccatgaggtagaggttgcagtgagccgaggttgcaccattgcattccagctttggcaacagggtgagactctgtctcagaaaaaaaaacaaaaaacaagtgatggtaacacataggttgtctaatacattcagagtctagagagacctggtatgtatctgagaaaccaaatagctgaatctctaaaattttatttttgtgtctggaataccttaattctgaagttttagttgttgttgaatttcacattctgacaggagacaagtagaggtacatgtgaagggttagtatgaacccagggttacagtttcaatctaaactgatactgcagagttaacattgaaacaaagcagctctagggagctggcaaaaattgaaggttagaagtcacttgctggctcttgaggcagtcttctgactctgaaactacttgagactaaaattttcaagaattttttaacttaattttgtaaagatataatttacggcctggtgcagtggctcatgcctgtaatcccagcacttagggaggccgaggtgggttgatcacctgaggtcaggagtttgagaccagccaacataatgagaccccatctctactaaaaatacaaaaattagctgggcatggtggcacacactcgtactcctagctactcaggaggctgaggcaggagaatctcttgaacctgggaggtggaggttgcagtgagtcgagatcaggtcactgcactccagcctgggtgacacagtgagactccatctccaaaaaaaaaaaaaaaaatacagtcaaatacatagaccttaagggtttttattttttaaagcatatgtacacaaaatggaagacagaaaaatagcaaaacattttggaagctggaatgcagattgatttaagcagtctgcccgccttggcctcccaaagtgctgggattacaggcgtgagccaccacacttggccgatataactttttcgtagtgaagcttcagttaacctgtacggtggctgcgctgtgaactttcacccaaatattgggctccttaaggggctgtttaggcttggggctgtcctagggtcggtgagtatctagtaagagtgtaaaccttctatttcccttgtgtgcgtgttttatctttgaaggaatgttgatatttggtcagtatgaacatacagcagcatggctgggaatacaggggcagaaatgtaaaggaaacgcatgtgaagtttgcttttaattactggaccgttgtattcaagaaccttcaatggcagtatcttgtctttgctccagggtcagattccctaaagaagaagggatctcctacttggagagtacaaattgggcttccagcagtctggcttctatacttagggaaaggctggaggtcttagtattcgttatgtaaacactcattcttgttcatttaactcaactattttcagtaagatgacctcattctcaactggaccagttgaaaagctttccagtccaggaattctttgtttttacataggattgttttaagctgctacgtgtggttagtggctaccatattggatagcggagctgcactatccagtgtggtagccactagccacatgtagcagcctaaatctaaataattaaaattaaaggtttagttcctcacttgcactagacatgtttcaagtgctcaatggccacatttgcccagaggctaccgtattgggcagagcagatatagaatatttctgtcattgcagaaattttattgggctgtgctgttctagtctagagaagaagactccaggtgtctgcaaggatgggtaggggacagttggctggttttgtggcatgtgggaggatatttaaatcatttgaccaatccttttatttttagcgtcatattcatattcacatccctctgtagaacaattcctgacctgttttgaggtattgttctttagattgctttcctccctgcaagcttgagatttaactttttttttttttttttttttggagacggagtctcgctctgttgcccaggctggagtgcagtggcgtgaacttggctcactgcaacctccacctcccaggttcaagcaattgtcctgcctcagcctcccaagtagctgagattacaggcacatgccaccatgcccggctaatgtttgtattttagtagagacggggtttctccatgttggtcaggctggtcttgaactcctgacctcaggtgattcgcctgcctcggcctcccaaagtgctgggattacaggcgtgagccaccgcgcccggccccagccgagacttaacgtctttagatctttaagtcaatccacattccaactttcaaaatgtttttgctgttgttcggtgttccattttgtgtacatatgctttaaaaaaacaaaagcccttcaggtttatgtatttcactgtaggtaaattatatctttaaaaaattaagttaaaaaattcttggcagccgggcgtggtggctcacgcctgtaatcccagcactttgggagtctgaggcgggtggattgcgaggtcaggagatcaagaccatcctggctaacacggtgaaaccccatctctactaaaaatacaaaaaattagccgggtgtggtggcgggcgcctgaagtcccagctactcgggaggctgaggcaggagaatccttgaacctgggaggcggagcttgcagtgagctgagatgtgccactgcactatagcctgggtgacatagtgagactccatctcaaaaaacaaaacaaaacaaaaaacataatttaattttaattagttatttaggaatgggtcttgctgtgttgcccaggttggtctcaaattcttgacctcaaaggatccttctgcctcagcctcttgagtagctgggattatagacatgcaccatggtgcctggctggttttttcttttaaaaaattaatttattggctcacacctgtaatcttaggtactcagaaggctaagtcaggaggattacttgattgagcctgggagtttggggcttcagtgagccatggctgacagaatgagaccttttttttttaaaaaaaaaaaaagataaaggacaatttttttattcttaatgaagttttaagagggaatgatggtaaaatgtgtctgcttaatctgcagtctttatccagaagtaaagtgcttcatcagaatttaaacatgtataagaatctccactaaaaaaatgtttgagctttacccaggcttcttgaacaatttttatatatcgccttttttgttccaccttggtttttgtcctttccattgtactaaaatttctcctgcaaatgtcaagagaattcagtgaacacttttaatccttatcttgctcgacttctcaacaacctttaactgaccatttccctctttttagaaacctgttctagctttgctgataccacctttacctgatttttgaccttatctccctggtcattttttttcactttcctttgcttagtctttctttatttcttaaatcctggagttccagctgggcacacctgtaatcccagcactttgggaggctgagttgggtggatcacctgaggtcagaggtcgagaccagcctgaccaacatggagaaacccggtctctactaaaaatacaaaattggctgggcgtggtggcgcatgcctgtaatcccagccacttgggagcctgaggcaggagaattgcttgaacccgggaggcggaggttgcagtgagctgagatcgtgccattgtactccagcctgggcaacaagagtgggaaaaaaaaaaaaattcctagagttccttgggctattgccctagggtacattctctcattctcttctaccttttacaaattctttctaggtgatcttatcattttctatagctttggttactctaagctgaaaactggaattcacatgatgtcctcttttcagaattcttgaactgtatatctagctgtatatatccacttggacttctaatggtcatctcaaattgaacatgtgaaagactaaaggcatagtcagtataaccttcccctaatcgatctccgtctgtgtttcgtatcagtgataccactatctacctagtagctgatactggaacatttacccccaacagataggcttttgacaaatgacaagtcctgtcatttctgtgtcctgaagattgattcactttgctacatcctcccagtttttctcttaatccaagaagctgtcccactgtatctgcattgatttacctgtaacagattcctaatgggtttcttctgctgtggccttctccttgccattctgcacattgcaggtagaatgatttttttcaagaatatgaatcagatctttgtctttcagtggcttcacaccaaccttatgttaagtgtcagcatcgtgaatttagctcttctgttcctcatctaccccttccgtgcctctaagtgttactgaagttctttccattccttgaaatactgaattccctctctttcctaggaactcttgctcatcatttgtctcagctgaaaaataatttcttcagagaaaaaataatttcttcagagaggtgtttcctgacccttttgccagatatttccattgtaccctgaatttgactttttttaatttttattttatttttttatttttttgagacagggtcttgctctgtcacccaaactagagtacagtggtgtgatcatagctcagtgaaactttgacctcccatgcccaagcgatccttccacctcaccctcctgagtagatgggaacacaggcatgtaccaccacttttggctattttttttggagacaggatctccctgtgttgcccaggcaggtgatcttgaaatcctgggctcaagcgatactccacctctgcctcccaaagtgctgggattacaggcataagccaccatgcctggccaatattggcagtataccatagtaagcgtttatttgaattacatgtttatttcatattaagaagtttgtttatatagaagtgatttttccactgataaagtaaaatatgatattctaaactagaggttcccaaactttctctgtttacaccctccttaatatattttttacatgtccctaagcttaacagtttgatttattaaataattaggttcagacagcttaagaagtatttatgggccaggcgctgtggctcacgcctgtaattccagcaggcggatcatgaggtcaagagatcgagactatccttgctaacacagtgaaaccccttctctactaaaaatacaaaaaaaattagccgggcctggtggcgggcgtctatagtcccagctaggctgaggcaggagaatggcgtgaacccgggaggcggagcttgcagtgagccgagattgcgccactgcactccagcctgggcgacagagcgagattctgtctcaaaaaaaaaaaaaaaaagaaaagaaaaaagtatttatgttctttcaacctaattgacatctaagaaatacacaaattggaagacaaagtcagatagatgtgatggctcgtgtctataatctcagctctttcggtgggcggatcacttgagtccaggagtttaagaccagtctgggcaacatagaccgtatttctacaaaaaaaaaaaaaaaaattgccaggcgtggtggtgtgtgtctgctgtagtcccagctactcaggaggctgagggaggattgctggagcctggaaagttggggcgagctctgattgcaccagtgcactccagcctgggtgacagagtgagacactctcaaaaaaataagaaagagaaagacaaaattacattttgatttcattcttaaataaccacagttatttaccgtatatacttgttgggcactacaaaacccaaaccgtggaatcatattggactctgccacccacattgcttactttttaattaaaacaaatttgcttttggctgggcatggaggctcatgcctataatcccagcactttgggaggttgaggtgggaagatcgtttgaggccaggagttcaagaccagtctgggcaacatagtgagaccccatcttactaccttattttattttttttaatttttaattttaaatatttatttagagatggagtctcactgtgtcacccaggctggagtgcagtggcatgatcttggctcactgcagcctccactccctggttgaagcgattcttctgcctcaggctcctgagaagctggccattactggtgcccaccaccacacacggctaagttttgtatttttagtaagagacagggtttcaccatgttggccaggctggtctggaactcctgacctcaggtgatctgccctgctcgaccttcaaaagtgctgtgcttacaggtgtgcgccaccgtgcccggccactatctcgctattttaaaaaataaataacatttgtttacatctttgttttctccactcattttttgctctaaattgatatttgcacagtatttttttttaaatcacagcaaccaatagatactcagctttgcaaagattatgatatcatcaaaaggaacatagtgtgatctattttgaagctgaactgtcttgaactagtagtttataaggtgtttgacaagtatagaagattactttttccctgtaatttagaatttcctgttgtgctctcgtgagttctctacagaatcccaggttgccttgggcacagtttgggaactgtgatcctaaacttttgatagtttggtgtatatgcttttagacatttttctccaaacattcaagcatatgcatatatttttccttttaacaaaagtgggctggtacatattggtcagcaacttcattttttccattcagcagtgtatcatggtaaaggtggtggattgaatatatacgtttaattttatgccagcctgaaaatttcattaaaacaatggaggacttaaaaaccctctagataacaaagaacaggaacaatgagaataacaacaatatcgtgaaagctggaaagcagaaaagactaatggcaactaattcgccaacttgagaaagctgtatcctaaaccaacagtggagagagccttcaaatagtcatgttatgttaccaaaccctttaaaagtctcaagattagctgtgtcctgtactgtggaggtggaggtgggacagaaaatatgaggagttgtttgaaagtctgtttcagaaaagtttccactcctgacctccctttcttctccccgtagacataaatagggtaactagagacttactatctggagtagaaaacgattattatctggactgagggataccatgcatagttaaggataaggtactgtgccttatagtggaaatctatatgctgaaggtagaaacctctagctttttttcctgacatagttctcagaatcttgcccctttctgctgtttcccattcaccaaaagcagcctctttcaagtctttgaggtattgttttggtataaacaacatgtctttaaattacctttttatttttatattttatgagatggagtcttcctgtcacccaggccagagtacggtggcatgatctccgctcactgcaatctccgtctctcgggttcaagtgactctcctgcctcagcctcccgagtagctgagattataggtgcccgccaccatgtctggctcatttttgtatttttagtagagacaaggtttcaccacgttggccaggctggtctcgaactcctgacctcaaatgatccgcttgcctcggcctcccaaagtgctggtagtacaggcatgagccaccatgcccggcctaaattacctttttataatgtaacttgtgattacttagtttatgctttatctgttgacttgaagatgaagattgttcttttttacatctgttccccacgtctgtgtacttgcatacttcttatcttccctccaagataccactgtatcttcccactatagggatgctataaggggcagtattaccattccaggtgagataattcttcattgttgtgtttattgcatgatacttagtatccttggaccccagcggtaaatgtcaataccaacctgaatgtattacagcaaccaagaatttcccacacatttccaaatgttaggttgaggtggtatggagtatctggttgagaagcactgggttagatcagtgtttagcttattactattatgtaaatggtagtcatagttaagccatgtagtataccaaggtttacaaccactgttttccctttcttgtacatttttctgttgtccctgaaattaattgtctttatcttttgtttagtgttctctgtacctactactaactgcaaactctcttctggttgtctgtttctcctttatttgctttcatacactttagaaattctatcaggatcacattcttggagccttttgactgacttttgaccgctcccttctggattggtggccctccaggcttaaggcacattgtcattctgcatctatttttactgttatctttagtattctttttgcctgactcttgtttttggatctcatttcctgcatcctgtgtattcttgacttactcccatatttgccagagtaccttctcctgtgactctctgagaaggatgcatgggaggtaaatattttgataacttacatctctgtaaaccttttttgttagttgttatgttagtttcagtctgtcattttgtggtactttctgggagattgctcaaaattttaaatgttttaatgttttacttttaacttcgaaataacttcaaatttaccgaaaaaaattgcaaaatattacagtttttctatatgcttcacctagctttgctccgaagttttgtttcagttttttttgtttgtttgaagacatggtctcactctgttgcccaggctggagtgcagtggcgtgatctcggctcactgcaacttctgcctcctgggttcaagtgattctcctgcctcagcctcccgagtagctgggattacaggttcatgccaccgtgcctggctaatttttgtatttttggtagagacagggtttctctatgttggccaggctggtcttgaactcctgaccttagttgatccacccacctcagcctcccaaagtgctgggatcacaggcatgagccactgtgcccaaccttacttcagtttttttaaggagacagagtcttgctatgttgcccaggctgatcttgaactcttgggctcaaacaatccttctgtctccgcctcccacgtaggtgggtctacaggtgtgcaccactgtacctggcctctccaatgttatagaactgcagcacattgtcaaggccaggcaattaacgttgagagaatactgctaactgatctgcacaccttattccaattttgtcagttgtcacatgacttttctttttctgaactgagactcaatccaggattataccttgtttaattgtcgtctccttaatctcagtctttcattctaggacagtctgtctttgtctttcaggactttgactgatgtgattgaagagtattagccagttattcttttttttttttttttttttgagacggagttttgcttttgtaccccaggctggagtgcaatggcgtgatttcggctcactgtcacctgcgcctcctgggttcaagcaattctcctgcctcagtctcccgagtagctggattacaggtatgtgccaccgtgcccggctaatgtttgtatttttagtagagacagggtttcaccgtgttggccagactggtctcgaactcgcgacctcaggtgatctgcccacctcggcctcccaaagtgttgggattacaggcatgagccaccgcgcctggcccttttccttttttattttttttttgagataggacatcactctgttgcccaggctagagtgccatggtgcaatctcagctcactgcaaccacaaactcctgggctcagttgatccacccacctcagccttctgagtagctgggaccacaggcacatgccaccacacttggctaatttttatatttctttgtagagatggggtttcatcatgttgcccagagtggtctcaaactcctgggctcaaacagtccacccatctcagcctcccaaagtgtgagattgtaggctgagccacagttccctgctggttgtttttaatattttgctattataaacaatgctgcaatgaatagccttgtacatgtgtatatttgtattattgtaggcatgtcttcaggtaaattccttaaagtggggttgctggattaaaaggtaaatacttttgtagttattaaatgttaccagattaccctccaaaaagattggatcaatttgtagtcctcctaacaaagtgtggaaaggcccttcttccccaccaagagaatgtgttataatttttgccaattgtcttataaatgaatttggacatctttcttaagcttaaggaacatttaaaaagctttatttgtaaattgtctccttatgtatttttcctattttccattaggctttttttcagttatctcttaatttaagaggtctatatattagggatattaggcctttatgatacatgttgcaaatatttttttctaatttatcagctgtcttttcattttgttcatttattattttttttaacttccaagcttaattgagtttttaatttctgctattatttttaattttcaagacccctttcttgtttttggccattcctttagaaaaagaataacaccctgttcttttttttcaatggatgtaatatttgcttttgcttctttgagatagtattagttttttttttttttttttgagacagtcttggtctgtcacccaggctggagtgcagtggctcaattttggctcactgcagccttcagaactcccaggttcaagcaattctcgtgtctcagcctcccgagtagctgggattacaagcacgtgccaccacacctggctaatttttttgtatttttagtagggttggggttttaccttgttggccaggttggtctcgaactcctgacctcaagtgatccgcctgtcttggcctcccaaagtgctgggattataggtgtgagccaccacactcagccccctctttttttttaattgtggtaaaatatacataacataaaatttactattttgaccatttttaggtgtacagttcattggcattaaagtacattcgcattgctgtgcaaccatcaccaccattcatctccaggaacctttttatcttcccaaactgaaattctgtacccattaagcaataactcccttttctccccctccctgttggtttataaaagttgactttatatagtttttgcttttatctgtttgttttggtctgtttttatccctagacatctggtgattcttggtcatcctttattttttattttatttttttgagacagagtcttgctctgtcgcccaggctagactgcagtggtgcgatctcagttcaccacaacctctgcctcccaggttcaggcaattcctgtgcctcagcctcccaagtagctgggattacaggcatgcaccaccatgcccagctaatttttgtatttttaatagagatggggttttgccatgttggccaggctggtctcgaactcctgacctcaagtgctctgcccaccttggcctcccgaagtattgggattacaggcgtgagccaccatgcccagcccgtctagttgtttttaataatgaccactaagaaactgcttgggaactcttaacacatggtggaatgtgtcaactttggggtacactgtgggccattttgtggggtaatatctgtatctttatggattttttttttttttttggtggactagttatagtctccagaaaagaatcttcagtctgcttgtatgggtgagacagactgctagcattctgggagatgagtggcaaagtgtgttcggagtctcatatgcagtatataattccatcttcaaattatgcctggagtccctgtgtctgcagactttccattttactcttttttgcattttacatttcactattttatctaaaggataaacttccaatcttgggtgggggagggtcacttacctgccatgtggagttaagtagggatctggagtctaactgcttcttaaactttaggccaccctattgagtcattgttcagacttattttgttgtgacatccccaaatatcactatctgttggttttttctccgtgaatgatctgttttcccccagggactagtcgccttcttgtgggtatagagcttcttgccagtcttatggaagctgagtggggaagggcctggaggggaattcacggtgtaaactcatttatcctcctggtatacccctgtgctcagctgtacatgatatactggactatcctgggtcatcctcctcagaaagtgaaactttcatcatctgccacggtaggagatggtatctaggagtttcactgcttcttattcagactttgagccagcgtttccttttcaacaccacccatactcctgactttcataggtatatgttgcctctgcttctgagcctttctgctttctgaggtcctatagctgctgcttttttttttggagacagagcttcactcttgtctcccaggctggagtgcagtggcgcaatcttggctcactgcaacctccacctcccaggttcaagcaattcttctgcctcagcctcccaagtagctgagattacaggcactcatcatcatgcctggctaattatttttgtatttttagtagagacggggtttcaccatgttggccagtctggtctcgaactcctgacctcaggtaatccatctgcttcggcttcccaaagtgctgggattacaggcatgggccaccacacctggccctgtgttctcatgtgtaaaatgaaggacggggaagggagaggagaccaaataccacttaagactgattccatattgacttaattataatttgctcatagcaaaataattagtttcatacagcagatttttaaaagagcaggtacttttgttctgtatagtcatgcaccagtagatatttagtaaatacatgtgaggtcagcatctcaagagggaagccacgctcctctgttaccagtcaaagactctgggtagccatgcaaggacaggactttatcaaatgctctcacccagtgatggttctggatctcaagtgaatataagaaaaaagaaccaacacaagcatacacacatatactgcaggaacacactctagaagtagatggaaatgaatgacagtcaaatccaaacaataacttcccctcaggatttaataaaatctaatattagcgaaggctctttagtctagaaagaaaggcaccagtcactgcaggtagagtggaagaaagactatgaaacagaagccaatattctaatttcagcttgacaacagtttactcagaagtgctgtattacctttctgtgtataagttttctctggggaaaaaaatggaggactgaacacatgtttacctcagttccctctccaaatcacactgaggttacagaaatcagtttttttttgttttttttttttttgagatggagtttcgctcttgtcacccaggctggagtgcagtggcgcgatttttggctcagtgcaacctccacctcccaggttcaagcaattctcctgcctcagcctcaccaggagctggtgtcaggtgtgaggattacaagcaatccttgcaccttggcttcccagagtgctgggattgcaggtgtgagccactgcgcctggtcgaaaatgattcttaagtttatttttctcagaggcaggtgtacagcaaatggctttttgttagactactcatgtcctccctcctctccagttttcattgtgatgaaaaccttggtcagataagatttcattgtgtccaatagtctaaattgaagtatatgtactctttttttttctcaattttctgccttagttactgtgaatatgtcttcatgaccttatttttagatagaaatataacttacttctcttctttacagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaaagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggtatgcacttttcctttattctccctcaaactccaagctcacatttgctgtgcattatccttgctaataagagtcctatttttttctcccactcatgaatatttctttaaaccagttagtctgcttgaagccttttatattgctgcattatgtagatgttccatcatttaatccttgtagacacttgcattgattccatttttttcataagctaatagtgcgatgaaattatgtctttacatttatacatttgtttctgtaagctaaattctcattattagaattgatggtgaaggaatattcacacttaaaattttaagataattaagttaccctccaaaaagttgaaccagtttacatttgttaagctttggcagtcttacagatcacagagttttgttttaatttgcatttttgagttttaagtttgaacatctgtttctgtgtttattggccacttttttgtatgtgcatggttttcctttgcctatttttcttttttttgagatggagtcttactctgtcgccaggctggagtgcaatggtgagatcttggctcaccacaacctccacctcctgggttcaagtgattctcctgtctcaaccccccgagtagttgggattacaggcacccgccaccatgcctggctaatttttgtatttttagtagagatggggtttcaccatgttggccaggctggtctcgacctcctgacctcacgtgatccacccaccttggcctcccaaaatgctgggattacaggcgtgagacaccgtgccctgcccctttgcctatttttcaactggattgtttctgtttttttttttttaatataggagacgctcaatgtaccaggcactgtgctggttcctaagaatgtagcaatgaacagaatatatgaccttcagggaacttggtgtcattctagtcataaaaatgtttaattgctgattataaatgtcataagaatggtccctcacgaaaggtaaaagccttcagtaccccaaaattgtttgatatttttgcttaataggagttttcagttcttacatagtaaaacttatctgtctttttttattttttattttttggagatggagtcttgctctgtcacccaggctggagtgcagtgacgcaatctcggctcactgcaacctctgcttcccggttcaagcagttctcctgcctcagcctcccaagtagctgagactacaggcacacgctaccatgcccggctaattttttgtattttagtagagacagtgtttcaccatgttgcccaggctggtctcgaactcctgagctcaggcaatctgcccgcctcggccagtctgcctaaagtgctaggattacaggcatgagccactgcgcctggcctaaagcttacctatatttgactttgaggcttctagtttttacgtcatgctttaagaagccttctcttgtcaaaaatctatcccataaggtaaactggtgtaaacatttctttggaagacaatatgatagtataaattatggcccattcaggcaatagtttgctagcagctgtttaagaatatagatctatattttgatactgaaagatgtctatataaagtgaaaacaggccaggtgctgtggctcacgcctgtaatcccaacactttgggaggccgaggtgggcggatcacctgaggtcaggagttcaagacgaggctgatcaacatggtgaaaccccatctctactaaaaatacaaaaatcagccaggtgttgtggtgcgtgtctgtgatcccagctacttaggaggctgaggcagggagaatcgcttgaacctgggaggcggaggttgcagtgagcttaggttatgccaccgtgctccagcctgggcgacagagcgagactctctcacaaaaaaaaaagaaagaaaaaaagtgaaaacagtaagttgcaaaatggtatgaaaccattttgttaaaagatatatatgacatatgtaggatgagtgtgagtatatatgtgtgcatatgcatttgtataggacatctggacagatattattaccattggctttggggagctagttaggaggtttatttcttggtagttgaaacagttctgagcactttctctttccaaccattaagtataataaattcttctggctgggcacggtggctcatgcctgttatcccagcactttgggaggccgaggcgggcggatcatgaggtcaggagatcgagaccatcctggctaacatggtgaaaccccgtccctactaaaaatttaaaaaattagccgggcgtggtggcaggcgcctgtagtccccactacttgggaggccaagacaggagaatggtgtgaacgggggaggcggagcttgcattgagctgagatcgtgccactgcactccagcctgggcgacagagcaagactctgtctcaaaaaaaataaaaataaataaattagtaaataaattcttcctcatagaaagacacaaagtacagagtcctagcaaattaaaaaaaaaaacaacaccaaaaaacctcttgtctatactgtcctagagtaaagccagatttccctactgaggttagcagacccatgatacttacacctgaaaagaattagcatttacccacaaatgccagttaacctttatagatgtaacactttcaagtacggttgataaattgaatatgcacgtagtaaaacctgtagcatgacctgaggaagtaggaattcttacagaattcatgtgtagtgacaatataattcactattttaataggccaaaggggaaaaaaatggtatctcagcaagtgctgaaaaacctgttagtaaaattgtttccttttgggtttaaatctcttagaaaactagtaataaaggaagcttccttgaattactaaagaatatcaatcagaagccaatagcagtttcaggtttaagagaatgaagtaagctcatggactctcttcttcctcctaccaaatccatagaaattatgaaaaaatattaaaaacacatgtgtcttcatactcacaaatgaggagacagttttggtagatcagaaactgagaatcagctcccactgggcaaaaagtagagggaaggtccaggcgggcagaaggaagattagtacagggaagtggtgtgatactgagtgctcatatttctggagatggtggaagtggagaggaaaggggacacccatggtaaggactgagtagttggggaatctctccctgcctgtgccacatgtcagcaaagaacaaatctgttatcaagccaaaattctaaggacaagagacaggatactcacccacacacgtacaccttgtaacacttggcaagagtgaggaacatccattttcagaacagctgctggggttcttagtgtccttattcccactgaaaatagttcaaggcagagcagcagctactgcccattatagccctttgccctcaattctcagcaagttacctaagtagagatgaactaacagtctatcaccatcctctgagaaaagccaacacaatgaaatagacaaattcagcaaataacagaactaaacctcagtattgattaatggggcaatgagtacaatagataatcctttaagggacttctacaacattagccactattgagttctgtggggtgctgaatgctggcttgtctctaatatgactgcacattatgctcctttcagttgatttacatgtttaagagtcagttatacttaggggagatttacttgttgcagtttcataattttattcagtattacataaaatgatgaaatatgagtgtaagaagaaagctcctcctttgaaaaacaaggtgaatactttgcaatgacagtagcgggttgctgcaaaaaaatgaatgctgatgcgctcatgcaggacagctgcaaaagatttgagggcgtgcgtgaaagtctaggactctgcactgagattactttgcaagttctttaagttcttgcttcgctttaaagttctaacctctatgtcatgagtatgccaggagataatggaagggaaactgaagaaattaggaatgttttctagaactgaaaagaaaggtctgagtctaaagttgaaaggctttgcaagtgccaatcaggattaaaacacacaaatacatacacaaactcacactaaatttagtgtagtaaaattatagcacatccaagagaaataacttggatggttacttcttttggagggaaaagggatagattcctgtgccgcaaaacattccagatggattaaaagtttggctaattaaaaccaaatacacagaaatgtgtacacgaatgcttgtaacagcattgttcataatatccagaaagtgaaaacaacctaaatgttcaacacctgatgaatggataaataaaatttggtatatctatacaatggaatattattctataaaaggaataaacaccgatatatacttaaatgtggatgcaccttggaagcatgctaagtgaaaagccagacacaaaaggccttataacatatgatttcgttcatttgaaatgtccagaataggcaaatacatagagatataaagtagattaatagttgccaggagctgggaagaaggggaatgagaggtgactgttaatgggtatagagtttctttgtggggtaatggaggtgttctggaattaggtagtagtgatagttacacaatctgaatatattaaaaaacagtgaattgtgttctttaatggggcaaattttgtggtgtgtgaatcacatctcaataaagctgttaaaaagaaacaaatataggccggccatggtggctcacatctgtaatcccagcactttaggaggctgaggcagaaggatcgcttgagggcaggagtttgagaccagcctgggcaacatagcgatataaatacatagagggatgtatatagatttagcgagactctattgctacaaaaaataaaattatctgcatgtggtggtgcatgcctgtagtcccagctcctcagatggatgaggtgggaggactgcttgaagccaggagtttgaggttgaagtgagctatggtagctcgactgcattccacgctgggtgacagcaagaccttgtctctctcttttttttgagacggagtctcactctttctcccaggctggagtgcagtggcgtgatctttgcttactgcaacctctgccttctgggttcaagcgattctcctgcctcagcctccggagtagctgggactataggcatgtgccaccacgcccggctaattttttgtatttttagtagagacggggtttcactgtgttagccaggatggtctcaatctcctgacctcatgatccacctgcctcagcctcccaaagtgctgggattacaggcgtgagtcaccgcgcccggccgaccttgactcttaaaaaaagaaaaaaaaaatacaggaaatcattctttttaagtttttggtttctttgtttgtgacagagtctccctctgtctcccaggctagagtgcagaggcgtgatctcagctcactgcaaactccgcctcccgggttcaagcgattctcgtgcctcagcctctggagtagccaggaccacagaggtgcgccactatatgcctggctaattttttgtatttttagtagagatggggtttcaccatgttggccaggctggtcttgaactcctcacctcaagtgatccgcccggcttagcctcccaaagtgctgggattacaggcatgagccactgtgcctgacctaaagattatttttaattgacaaaattctatatatttatggggtacaatgtgatgttttgatatatgtttactttgtgaagtaaatcaagataatcagcatatccatcactcacttcgtcgtgagaacatttaaaatcaattctcatctattttcaagacacagtacattattattaactatagtcaccagactgtacaatagatctctaggaccacttcctcctgtctaacggaagctttatgacccttgaccaacatcttccaattctctgccccacccccagcccctggtaactaccgttgattctctacgtctatgagtttgactttagattccacatgtaagtgagatcatgcagtatatttttttgtgtctggcatatttcacatattatgctccagattcatccatgttgcagatgacaggatgttttaaggctgaattgtattccattgtgtatatatactacattttctttctccattcatccactcatgggcattgaggttgatgccatgtcttggctattgtggatagtgccgcagtgagtatggggtgcaggtacctcttcaacacactgattttattgtctttgaaatacactcagaaatggaattgctggatcatatggtagttctatttttaattttttgaggaacctgtatactgttttccttcatggctgtgctaattcacattcccaccaacagtgtacagggttcccctttctccacattcaagtcctttgcctgctttttaaattgggttatgttcttgctattcgttgtttgagcaggagaccatttttataatcttatattgataagacatttttgcccataataggaagctcagaagcaatgaaaatataccaaattgactctacagacatttaaatcttgtgtgcatgtgtgtgtgtatagcaaaagttagatgaaaatttaaaaatttagatatgcatgcccttttacccagaaatttaacttgtagtaggtgtgtccaagggaaacagtagaactaggatagatcaagagttttaattgttacattatttagaggtaaaaataaatggccatcagtagggaattggttacaatacagtatgcattttttcaggcaaaagagaactgtccatgatatagtgaatggaaaaaagcagcttcaagaagagtaagtttaggccgggcgcggtggctcatgcctgtaatcccagcactttgggaggccgaggtgggtggatcacctgaggtcaggagttcaagactagcctgaccaatatggtgaaactccgtctctactaaaaatacaaaaattagccaggcatggtggcatgcgcctgtagtcccagctacttgggaggctgagacaggagaattgcttgtacttgtgagttggaggttgcagtgagttgagatcgcaccactgcactccagcctgggtgacagagtgagactctgtctcaaaaaaaaaaaaaaaaaatttagtgtgtttaagaaatacatgttcaaagggcttgaaagtccagaaggaattatgggctcactgccatttatttaaaaatatttatggtcgtgtatgagaaaaaataactacttaaaaggttgtttccacatataaagtaaatgtttataaaaatgtccaactctttttttctagatattaatgtggtttttttttttttttttttttctggagacagagttttgatcttgttgcccaggctggagtgcagtggcgtgatctcggctcacggtggcctccacttcctgggttcaagcaattttcctgcctcagcctcccgattagttgggatgacaggtgcccgccaccacgcccggctaattttgtatttttagtagagacagggtttctccatgttggtcaggcttgtctcaaactcccaaactcaggtgatccgcccgccttatcctcccaaagtgctgggattacaaatgtgagctactgcccccggcctaatgtgttatttttaatttagtgctttggaaaaaagttaaggtagatccttacctcattctttacaccaaaatgaattccagctgttaataaaatatttagttgcgagttctttttttttttttaaatttattcccatgggtctgggaaccaatgaaattagttggtagttctaatactgtttattgagtgatttgctcttttccctgtggttcagaaatgcaacctaccacagagtctctttggatttgatctctattccatgctggctctatttgccttaattagcgtagttttatcatttgacaggacctggcgctccttattcacctctctcctttaattcttttcaaaaatttctaggaatttctcacatttttgtcccaaggtaaattttggatttattttgtaatcttttaaaaaagtatggtttttacttgttgttgcattatatttatagattaatttagggacagttgctttcattgcaaaagacttcctgtcccttagtcatatttcgcatcttttcacttaggttttgcgcattgcttatgtttgttcttagatactgtataccttccttactgctgatgggcccgttctgaggtatgcactgtgttttgttggagaaccatgtgcttgcatttcttacgtgcacagcacggggaacctcattccacatccagggtggaatgtgacccaggtcagttgcatcaaacgaaaactgtccagtgccgttagtttaacatgatggctacttttaacttctttttttttttttttttttgagacggagtcttactctgtcacccaggctggagtgcagtggcataatctcagctcgctgcaagctccgcctcccatgttcacgccattctcctgcctcccgagtagctgggactacaggcgcccgccaccatgcccggctaattttttgtattttttagtagagacagggttccaccatgttagccaggatggtctcgatctcctgacctcgtgatccacccgcttcggcttcccaaagtgctgggattacaggcgtaagccaccgcgcccggccttactttaacttcttttttttaaaaagttcttttttattttttcagttatttttgaggcagggtctcgttctgttgcccaagttggagtgccgtggtgggatcttggctcactgcagtctttgcctcccaggctcaacccatcctcccacctcaccctcccgagtagctgggactacaggcatgtgccaacatgcttggctaatttttgtattttttgtagagaagcggtctcactttgttgcccagactggtcttgaacttctgagcttaagcaatccttctgtctcagcctcccaaagtgttaggattacaggcatgagccaccgtgcctggccgggtactttaaattctaaaatgacacctcaggttttgttttttatattactaccttttgtacttgcagagtgctctgtaatttgaactccagtttttgtttgttgtttattcctaacattttatcctttgtttcttgggtcactttgaaattttagtactttgggagtaaaataaattgtgtataccaattgcatttttccttttttagttgatcagtttagtgaaagcaagtgggtaaagaatggtggatttaactgtcattttataaaatctgtttctgagtaaaataaattgtatataccaagtgcatttttccttttttaattgattagtttaatgaaagcaagtggataaagaatggtggatttaactgtcattttataaaatctgtttctggatagttcttggcccacagatattaaaaaggaaaggtgaagaaccaagttgtttttgtagagaaaagataacagatatttcttgctttgtaagtggcatgacatgatagttaacagcccagtttctgtagtcacggtacctacaatcaggatcttagttctaccatatgctagttaagtgcccttggggaggtaacaacctctcaaagcttctaatgtctccatttgattgactggttgattgattgattgattgagatgaggtctcgctctgttgcccagactggagtgcagtggcataatctcggctcactacagcctctgcctcccaggttcaagcgattttcctgcctcagtctcccaagtagctgagattacaggcacgctaacatgcccggctaatttttgtagttttagcatagacagggtttcaccatgttggccaggctggtcttgaattcttgacctcaggtgatccacccgccttccaaagtgctgggattacaggcatgagccaccgcacctggcccagtgtctctatttgtaaagtagggatactatcttaacacccagggaggctataagaactaaatgagacaggctagtgcttgtcttatgagtattttttaactgttgttttacttctggtcccagtgagataatggtgtgtgtaagtgagacactgtcatctagggttctccttgaagatcgtaccttgaagggcatttctaccgaataagaaatccatgtttatcatctgaaaatgaaaataaagatacagataagaggaaaatgtgtaataatttagaatctccatcattctaccaccagaaataacattgttaacaagagcaccatgatactagtttgaaattcacatccatatcccattgtgggggacactgccttcttatttgaggagcctcaatcaaagttgtggggcctaaagtttaatttttattgttgttaggggtattattttacaacgaaaaataattctcaatgcagtttctcaaatggtgggattccttatcttccactgggcccattcccccatgtagacacaaggttatgattaggtaactgtaagatgtgaaatagtaaacactagaggcaagtatatggtctgttcctagattagaagccccaaatctttatctgataccctgatgaagttggagcatgggactatcttcctgtctactgtatttgcccaaagcctagagcagaatggacgtgagaaaggacctcttttctgtttactgtaccctgacctttgctcctatgttaagccttgaaaattgagaggtactctggtgggagattaacaggaggaaaaataaattgttcacttctttgtctgtctctcccctcataaaagacaaaacacttcattcccaagacactcttatcatcttttctatcctgtttatatcaatgcatggcagaggccattcttggagttacaaagggagctggttaagatatgtggctaacaatcctcatttttcctgtcttaactcagcagacttaaccgtcagactgatggttagctaatttgttgctctgcccattcagcattggtgaacaacctaagtcatgtctgtacttctgtgagcgtctaagccttgcctcagcttttttgtatttacttagaaataatgtcctgggtggccaggcgcggtggctcacacctgtaatctcagtactttgggaagacaaggcaggtggatcacctgaggtcaggagttcgagaccagcctggccaacatggtgaaaccccgtctctacaaaaaaaaaaaatacaaaaattagctgggcgtggtggcgggcgcctgtaatcccagctactcacgaggctgaggtaggagaatcacttgaacccaggaggggtgggttgcagtgagccgaaatcgcaccattgcactccagcctgggtgaaaagagcaaggctttgtcttaaaaaaaaagaaaaaagaaaagaaagaacgtcctgggtttatttcctggggcttttctaggttcagtggatcattcagggatatatataagcacatatacatgttacttacatttacctgaagactgtcctatggtgtggccaaaaagccacctttaaattttatttctcatcttgggaggctggagcgaaaggatcacttgaggccagaagttcaagaccagcctgagcaacatagcaagaccctcatcttaaaaaaaaaaaattaaaaaattagctgggtgtggtttcacttgcctatagtcccagctaactatccaagcaggaggatggcttgagcccaggagtttgaggctgtagtgagctatgattgtgttactatgccccagctgggatgatagaaagagaccccatctccaaaaaattctatttactgtcttaaaatgtgcttcactagctgggtgtggtggctcacgcctgtaatcccagcactttctgaggccgaggcgggcggatcacaaggtcaggagatcaagaccaccctggctaacacggtgaaacccctcgatgatagttccattcgattctatgcgatgattccattccattccattggaagatgattccattcgagaccattcgatgattgcattcaattcattcgatgacgattccattcaattccgttcaatgattccattagattccatttgatgatgattccattcgtctctactaaaaatacaaaaaaattagccgggcgtggtggcaggcgcctgtagtcacagctatttgggaggatgaggcaggagaatggcgtgaacccgggaggtggagcttgtagtgagcagagatcgtgccactgcactccagcctgggcaacagagcgagacgccatctcaaaaaaaaaaaaaaaaaagtgcctcactagctgttatccagttgagctcacctcacagcgttatttggtgtcatgagtataataacttatcaagatgtatgatattgtcccttgctgatactaaagtacatacctttaccaaataatagagtcacagtgatctcatcagttaatgctaattgtgattttaaaataataattctttcagttaccaaaaggataggcacatttgactatgtgattaagccctttagaagtcacgctttaagagaaggttaagctgtgggaagctgttagtatttccttctagctatccattccttctctaacaatgcttcagtaacttaaaaatctaatgtgaaatgattcctcacagtatgtctctctagattgcattggttagagcctaatatattttattttttacaaaagacataactttaaaaatatagtatcaatattatatagtaatataggttaaccactgtatgtgttaagtgctgtgtataggttaagtgtttggagaatgactctactgaaaatggcttgtttttccatcttaacttttctttcttcctttatttaaggattcctagatgaggttatgaagaagtatggcagtttggttccactcagtgaaaaagaagtccttggaagattaaaagatgtctttaatgaagacttttctaataggtatataaatgatgctaaagttaagcccttgaaaataaaatttttggcatatatgacttttctcttgatttacagaagaaaagatatttagcagtaaattgagaagtactcatgttttttttaccttttgtttcaaaatctttctctttcagaaaaccatttatcaatagggaaataacaaactatcgggccagacatcaaaaatgtaacttccgtatcttctataataaacacatgctggatatggacgacctggcgactctggatggtcagaactggctgaatgaccaggttagtatattgtagtttttcagtgtggagaagttgcagaggatgttagtcaataaaatataatctctagtttggcttctcagttgtcttttggaataaggattcttcattctttactggttacttgccccaggatccaaacggtttgattactattggcagtaataatatattatttattctgattgggatgtactgaattgtatagggttagtagcctggttttatttatttattttgtttttctttctccaacttaactggcagagatagtaagctggttttatgttgactttttataggtcattaatatgtatggtgagctgataatggatgcagtcccagacaaagtaagtgaaaacttcctcttctgcaggagagagtgttcttgtgtattaaaatgagtagtttttttgtttttacatttgatgtaattatctgacattccttaaattttttaaaagaagagttcaattttttcttgatcatgtactgggcttgatcgtaagttccatcaaatcacttctttttgttctttttgagatggagttttgctcttgttgcccaggctggagtgcagtggcgtgatctcggctcattgcaacctccacctcccgggttcaagcgattctcctgtctcagcctcccgactagctgggattataggcatgtgccaccatgcctggctaatttttgtatttttagtagagacagggtttcatcatattggtcaggctggtctcgaactcctgacctcaggtgatccacctctgccttggtctcccaaagtgctgggattacaggtgtgagccacagcgcctggccccatcaaatcacttcagcataagaaaatcactgtgcaattgttttcctatttatttgtgttagggtaggtatgtttgttgatatctggagagggcctttttttggtggggagatgtgcaaaagggactggctaagctttttacatttatgtatttattttacttttttttttttttgagaccgagtcttgctctgtcatccagactggagtgtagtggcgtggtcttggctcactgcaacctccacctcctgggttcaagcaattctcctgccttagcctcccaagtagctgggattacaggtgtgtgccaccatgcctggctaatttttgtatttttaggagagacaggtcttaccatgttgggcaggctggtctcgaactcctgacctctggtgatccgcccacctccccctcccaaagtgctgggattaaagatgtgagccaccatgccaggccagctttttacatttaacttaaaatcttgctctctttaaaaatgtaaaaaaaaactcatctttcatttttccttagataaatctttgatactcagttcaaatacagattgaaccctcataaactctaaattctcttaagagttttgttacatatcaaaactatttttttacttaatgtatttttctgagtacacaaatgcctgatgggtgcaaaaatttccaagtgctgtataaaacttaccaatctaataaagtaacataaatactaaaaagtcagattctgataccgtttatgaatatagaaaatgttttatgactttccacttaaattataaatctgttatacatttataaattggaatcatgaggctaatctgctagatgctctattgtcaaattctcttaatcatcagaaagtttaaacaatatagattatctttaacataaaagtattaatttcaagggtttcatttaccaccattgtacatttaattctaaacattcatggagtcaaaaggacacttaactaaggcagtggttctcaaagcatggtccccatactagcagcatcagtatcccctgagaacttactagaaatgcacattctgagactccatcccacacctactgaatcagaaactggaggtgggggaccaccgatttgtgttttgacaagctctctagatgattctgatggacaccaattttgagaatcactgctctagagacagctactataagctctttcttatttatttgtttttattaaaattataaaacataaccttctttttagagacactaaaaagacactccaggctggaatgcagtggcacagtcatagctcactgtagccttgaactcctgggctcaagcaatcttctcgccttagcctcccaggtagctgggactagaggcatgtgccactgtgctactatacccagctagtttatttttatttttggtagagccaggagtcttgctatgttgcccaggctagcttgagctctgggcttagctaaagtaatcctctcacctctgcctctcaaaattgctgggattagaagtgtgagccactatgtctggcagctctttcagtctgtatgttaagctgcatggttatcaaaagaatgtgcctcagaaccgtctgaaaggtttataaaaccagattactgggccctgccttcagagtttctgctttaataggtctgggatgaggcctgataatttggatttctaacaagttcctagatgatgctgacactactggtcaggtgaccacactctgagaaccacagtgctaagggaacagttttatcacctcaagttactgaatgagcactttaagatcacaatatgtttaccctctaagatgagctgatataccacttacttataagtcagaaattcaaagccaaggacgcaggacctgatactctgtacagccagggtaattctgtggtactagaaataatcatgccaaggcctttttatggttactgtaacaacaggagtctctaaatccacatccttcacatggagttagttttgtaatccatctcccttgagttcaaggtaattgttacctcattttttcatagcctctttcagctttttcacctgatttagagagatttgtcaggttgcttctctacttgattggattcaggtagtctatttactgccccattccaaagctgactatagaccacagctgtaaggtcattccaataaaactttggaacagcattttctgtaaaccatgtaatgtattttctatattttgatcattattatcattattattattttttgagacggagttttgctctggtgcccatgctggagtgcagtgatgtgatctcagctcactacaacctctgcctcccaggttcaagagattctcctacctcagcctcctgagtagctgggattgcagatgggtgccaccacgcccggctaatttttgtatttttaggagagacagtgtctcaccatgttggccaggctggcctcgaactcctgaccccagatgatccacttgcctcctcaatcattgtttttatgaagaaatttttccttcctttttgtctgctttacattcaaacattttaaaatttcctcttttgaagttaaatctgggcacagcctaatataatctggttgcttgtgtttgttgtctgttctaggttcacttcttcaacagcttttttcatagacagctggtaaccaaaggatataatggagtaaaaagatggactaaaaaggtattctctttatttcttttttattccaaatttgaaacgcagatgataaaccactttgtgtggaaggataagtactttaatgccaatacgatgttaagtagaaacagactttttaatgtgacaagttttaaatttgtttcttttaaatcttattgtttgaaagaccttaattgcctactggtcccaattatagtggtagaacagtgggatgataaagaaggagctgccatcatttggtgttatctggtaggcttgtcagcagacagcagaagctttcaacaattttttgctggtgctgggcacggtgcctcgcacctgttgtcccagctacttgggatgctgagaccagaggatcacttgagcacaagcatttgaggccagcttgggcaacatagccagatcctgtctcttaaaatgttaactgatccatcaggagaaataacttttatatcacaatctattcataaaatcttatacatacatgtaattgaaataatttccaaaaaccatgtacctaatttactatgtatgatgtactctagtcagagagtggtaagtgctatttgctatggaaacatcagaacacagtatgagaatacaaggtaactgggatagggtagcaggaggaagatgggctagttcttttagataggcttgtcagcaaaggcctctttgaagagatcccatttcactgaaaactgtgaagatcagaggagcattcccagtagatggaagagtgaatgttaaaggccctgaagcagaagtgagtttggtatattggagtattacacacatgagatcagggaaggaggcagggatcaagtcatgtggcgccatataggccctggtaaagagtttggatcatgagggcaatttgaagacattagagagtttaggccaggtgcggtggctcacgcctgtaatcccagcactttgggaggctgaggtgggcggatcactgaaggtcaggagtttgagatcagcctggccaatgtggcgaaaccctatctctactgaaaatgcaaaaattagccgggctgtgatggtgggcgcctgtaaccccagctacttgggaggctgaggtgggagaatcgcttgaacatgggaggtggaggttgcagtgagccgagattgcactattgcactccagccttggtgacagagcgagactccatgtcaaaagaaaattaaataaaaaataaaaatgaagacattagagggtttaagcagcaggcaaggagtgtgtatgagtgtgtgtgtaaatgatagataggattgtccttagcaacattgattcattcattcatcatttatttattgatttattttttgagatggagtctttcaggcgctatcttcgctcactgcaacctctgcctcctgggttcaagcgattctcctgcttcagcctcctgtgcagctgggattacagtcacctgccaccgtacccggctaattcttgtatttttaatagagacgggatttcactatgttggccaggctggtctctaactcctgacctcaggcaggtgatctgcccgcctcagcctcccaaagtgttgggattacagggtaagccaccgtgcccggcattaaacatttattgagtacctgttatgtgcctatatggaaaaacttttttcctttgctgtcacaccacaacagtagtcagcacagaagacttctgtgaccaaagcaagcaagcaagcagttctgcagcgaccactggctggatgccctctaattcaattccgacctgtctacctggagacagtgccacgtcccatagtttgagggctcatgcctcaagagtgccccccacccacttcagacaccagttgcaagtccaggcttctgaaacttctgaccaacagacttcaagtgagggttcccatgccgccctccttgaatttgattaatttgccggagcggttcacagaattctgggaagttcttacctacatttagcagtttattatataggatattacaaaggattcagatgaagagatgcatgggaagagatgtaggggagtgggcacagggattctctaggacctccacaggcacatcaccctccaggaacctccacatatttagtatccagaagctctcccagtgcagtcagtttttatggaggcttcattacataggcgattgactaaaccagtgaccattggttaacctttagcttctcttctctccctggtggttggggggttgggtggggctgaaagtcacaatcctctaattctgccttgctcttatcctaaagccacctagcagctgccagccatcagttaatcatcaacatacaaaaagacatcactttgggcctgggtcatgtccccgtaatcccagcactttggaagtctgaggcaggcagatcacttgaggtcaggagttcaagatcagcctggccaacatggtggaaccctgtctctactgaaaatacaaaaattagctgggtatggtggcatgtgcctgtagtcccagctacttgggaggctgagacaggagaatcgtttgaacccaggaggtggaggttgctgtgagccgagattgcaccactgcactccagcctgggtgacagagcaagactttctaaaaaaaaagaaaaaaagacatcagaaattccaaggactttagggagttgtatgccaggaaatgaggtcaaagaccaaatttattattttacagtatcatagtgccagacattatagtaaatcaagaaataaagaggtaagtaaaacaatattagagacagtttttgctttcacaaagtctgcagtctagtggtggagacagcacctaccacagtttgtatttatatttttggtggtgtaattatttgtttagtgggtacaaaagaaaagtactacaggagtgtattggaatgcaggtttggttaacctagcctgagggtaagggaatgtttctcataggaagtaatatttaagcagaaatatcaaagatgaatacaagttaactaggtaaatggagaataggggtatgtgaaacataggcagaaggaataagtatctggtagaagaatgggaaaaggctagtgtagctgaaatgcagagagttaagaagacagtggcatgaagtgtacctgatccacagatcagggccttgaggtttgtattttggattttatcctaaatgtaataggaaaccattgaatggtttttagtgacattatccactttgtagtctttgttctaacagtactgaagaagatggatgggtatgggagcaaagttgatgtgggcagaacaggagaccatttcagattcatggtactttgaagtagaatgatagcaggagagatggaagatgagtgtgatgtaggaagtaaaattaacaggatttggtgataagttggttatggagatgaaggacaaggaagtgtgaaagatgacttccaagtatgtgacttgtatgactggacggcctatggttgtatttacattagaaaaatgtaggacaactagtagaggattgttcaaatttaaaatgtacagtcatataattggatgctacttaagcaggaaaagctgtgtagataatgaacgatgggccgggcacagtggctcacatcagtaatcccagcactttgaggggccgaggcaggcggatcacgaggtcaggagatagagaccatcctggctaacacggtgaaaccccatctctattaaaaatacaaaaaaattagccgggcgtggtgacggatgcctgtagtcccacttactcaggagactgaacccaggaggcggagcttgcagtgagccaagatcgcaccactgcactccagcctgggcgacagagagactccgtctcaaaaaaaaaaaaaaaagataatggaagatgcttatattccatttggggtgggaaaaattacaagcagtgtgggcaaaaaatatacattcatggaaaagtatctgaatgataaacatgagagtgaaagaataaagtcaaatatgtgagttgtttcattaaataataaactaaattattccttcctctagatcaggggtgtccaatcttttggcttccctgagcctcactggaagaagaagagttgtcttgggccacacataaaatacaccaacactaacaatagctgatgagctaaaacaaaaaaaattgcaaaaaagatctcataaaagaaagtctacaaatttgtgttcggctgcattcagagccgtcctgggctgcatgctgcccgtgggctgtggactggacaagcttgctgtagatcctctgagattgggttaagtaaaaaaaaaaaaaacccaggtttatgctgaatataagaagtatacataaaataatatgaaaaagaaaggttgaaaatgaagtgacatttaaagaggctgggcgctgtgtctcacatctgcagtctgaacactttgggaggcctaaaattactgtagatgggaggattgcttgagcccaagagtttcaaatcagcctaggcaaccaagcgagaccccgtttctataaaaaatttaaaaaacttagctggccatggtggcagcctgtggtcccagttatccagaaggctgcggtgggaggatcacttgagcctgggaggtcgaggctgcagtgaaccctgatcacgccactgcactcctgcctgggtgacagactgagaccttgtctcaatttaaaacaaataaaaaaggcaactacaggaaagttaaacaacctgttcctgaataactcctgggtaaataaagaaattaaggcagaaatcaagaagttctttgaaaccaatgagaacagagagacaatgtaccagaatctctgggacacagctaaagcagtgttaagagggaagtttatagcactaaatgcccacatcgaaaagctggaaagatctcagatcaacatcctgacatcacaattaaaagaactagagaagcggctgggcgtggtgactcatgcctgtaatcccagcactttgggaggctgaggcgggtagatcacctgaggtcaggagtttgagatgagcctgaccaacatggagaaaccccatctctactaaaaatacaaaattggctgggtgtggtggcacatgcctgtaatcccagctacttgggaggccgaggtaggagaatcacttgaacccgggaggtggaggttgtggtgagctgagattgcgccattgcactccagcctgggcaagaagagtgaaactctgtctcaaaacaaacaaacaaaaacaacaacaaggaaatagagaagcaagagcaaacaaatccaaaagctagcagaaaacaagaaataactaagatcagagcagaactgaaggagatagaaacacaaaaaaacccttcaaaaaatcagtgaatccaggagctggattttttgaaaaaattaacaaaaaatacctctagctaaactaaagaagaaaagagagaagaatcaaatagacacaataaaaaatgataaaggggatatcaccattgaccccacagaaatatacaaattactatcagagaatactataaagacctctacacaaataaactagaaaatctagaagaaacggataaattcctggacacatacaccttcccaagactaaatcaggaagaagtggaatgtctgaatagaccaataacaaattctgaaattgaggcagtaattaatagcctaccaaccacaaaaagcccaggaccagatggattcacagccaaattctaccagaggtacaaagaggagctgataccattccttctgaaactatttcataacaattgaaaaggaggaactcctccctagctcattttatgaggccggcatcatcctgataccaaaacctggcagagacacaaaaaaagaaaatttcaggccaatatccctgatgaacatcggtgcgaaaaattctcaataaaatgctggcaaaccaaatccagcagcacatcaaaaagcttatccaccatgatcaagttggcttcatccctgggatgcaaggctgattcaacatatgcaaatcagtaaacataatccgtcatataaacagaaccagtgacgaaaaccacatgattatttcagtagatgcagaaaagaccttcgataaaattcagcatcccttcatttaaaaactctcaataaactaggtattcatcaaacatatctcaataataagagctatttatgacaaacccatagccaatatcagtgggcaaaagctggaaacattccctttgaaaactggcacaagacaaggatgccctctcccatcacttctattcaacataatattggaagttctggccagggcaatcaggcaagagaaagaaatacagggtattcagatagaaagagaggaagtcaaattgtctcttgcagatggcatgattctatatttagaaaatgccatcgtctcagccccaaaaccccttacgttgataagaaactttagcaaagtctcaggatacaaaatcaatgtgcagaaatcacaagcattcctatacgccagcaatggacaagcagagagccaaatcatgaatgaacccccattcacaattgctacaaagagaataaaatacctaggaatacagtttataagggatgtgaaggacctcttcaaggagaactacaaaccactgctcaaggaagtaagagaggacacaaacaaatggaaaaatattccatcctcgtggataggaagaaccagtatcttgaaaatggccatactgcccaaagtaatctttttttttttttttttttttttttttttgagatggagtctcgctccattgcccaggctggaatgcagtggcatgatcgtggctcactgcaacctccacttcccgggttcaagcaattctcctgcctcagcctcccgagtaggtgggactacaggcatgcaccaccatgcccagctaattttttgtatttttagtagacacagggtttcgccgtgttagccaggatggtctcgatgtcctgacctcgtgatccgcctgcctcggccttccagagtgctgggattatagatgtgagccaccactcctggctgcccaaagtaattaatagatttaatgctattcccatcaaactaccattggcattcttcacagaattagaaaaaactactttaaaattcatatggaaacaaaaaagagcctgtatagccaagacaatcctaagcaaaaagaacaaagctgtaggcatcacatacctaacttcaaactatactacaaggctacagtagccaaaacaacgtggtattggtaccaaaacaggcatatagaccaatggaacagaacagagacctcagaaataacaccacacatacacaaccatctcatcattgacaaacccgacaaaagcaatggggaaaggattccctatttaataaatgatgctgggaaaactggctagccatatgcagaaaactgaaactggaccccttccttacaccttatacaaaaattaactcaagatgaattaaagacttaattgtaaaacacaaaatcgtaaaaaccctagaagaaaacctaggcagtaccattcaggacataggcgtgggcaaagacttcatgacaaaaacaccaaaagcaattgcagcaaaagccaacatggattctaattaaactaaagagtttctgctcagcaaaagaaactatcatcagagtgaacaggcaacctatagaattggataaaatttttgcagtctacccacctgacaaagatctaatatccagaatctacaaggaacttaagcagatttacaagaaaaataaaccatcagaaagtgggcaaaggatatgaacagacacttcgcaaaagaagacatttatgtctgtagtctcagctactcgagaggctgagacaggagaattgcttgacctgggaagtggaagttgcagtgagccaagattgcgccactgcactccagcctgggcgacagagtgagactttgtctcaaaaaaaaaaaaaaaaggacatttatgtagccaaaaaacatatgaaaaaacctcatcagttgggcgcggtggctcacgcctgtaatcccagcactttgggaagctgaggcagttgtggtggtgggggcctgtaatcccagctactcgggaggctgaggcaggagaatcgcttgaacctgagaggcagaggttgcgtgagctgagattgtgccattgcactccagccttagcaacaagagcaagactccgtctcaaaaaaaaacaaaacaaaaacagctaatcactgatcattagagaaatgcaaatcaaaaccacaatgagataccatctcatgcgagtcagaaatgacaattattaaaaagtcaagaaacaatagaagctggcaaggctgtggagacataggaatgcttttacactgttggtgggaacgtaagttagttcaaccattgtggaagacagagtggcaattcctcaaggatctagaaccagaaatatcatttgacccagcagtcctattactgggtatatacccaaaggaatataaatcattctctatagagacatatgcgtgtgtatatttattgcagtactcatagcaaagacatggaaccaacccaaatgcctatcagtgatagactacataaagagaatgtggtacatacgcaccatggaatactatgcagccatttaaagaatgagatcatgtcctttgaagggacaaggatgaagctggaagccatcatcctcagcaaactaacagaggaacagaaaaccaaacactgcatgttctcactcataagtgggagttgtacaataagaacacatggacatagggaggggaacaacatacaccggggcctgtcagggggttgggggcaaagagagggagagcattaggacaaatacctaatgcatgcagggcttaagacctagatgacagcggggtgcggtggttcatgcctgtaatccagcctgggtgacagagcaagactctgtctcaattaaaaagaaaaaaacaaaactagatgacggattgataagtgcagcaaaccaccacggcacatgtatacctatgtaacaaacctgcctgttctgcacatgtatcccggaactttaaaattttttgaaaattcaagttttcattaaaagaaaaaataaaaggtactaggcagctgggcgtggtggtgtgtgcctgtagtctctgctactccggaggctgaggtgggaggattgcttgagcccaggagtttgagactgcggtgagcagtggtcacaccactgtaccccagcctgggtgacagaccttgcctctaaaaataataatttgtttgaaaattgtagaaatttaaaggtactagacaaattgaaacaaaaacagaaaggaatattaatcatattaatagcagttgaaatagaatttaaggtgagaagcaaattgtgtaattatcagatttcaatataaaggagatataatgaccaatctttatgcaccaaagcacacagttgctaaatatgtgtaatacaattaaaacagaaacaagaggaccttggtaaaatagtgatagtggcagacttttctcataagtggataaatctagtagacaataaagacatatacaaaaattacagtcaatataattgatttaatagatgtttatgctccttaagagaatatacatttattgctatggttcaggaatatttgtaaaaattgaacatgtacttagccacaaagaaaattattttttattagccgggcaaggtggcatttgggagcccgaggcaggtgaatcatggggtcaggagttcaagaccagcctggccaagatagtgaaacctcttttctactaaaaatccaagaaaattagctgggtgtggtggtgtgcgcctgtaatcccagctattcgggaggctgaggcagagaatttcttaaacccaggaggcggaggttgcagtgagctgagatcatgccactgcactccagcctgggtgacagagtgagactccatctcaaaaaaaaaaaacaaaaaaaactagtaagaccctgaactcagtagaagactcagtgatgaaaaggtttataagaaaggcttttttttttttttttttttttgatggagtgttgctcttttgcccaggctggagtgcagtggcacaatcttggcttgctgcaacctctgcctcctgggttcaagcgattctcctgcctcagcctcccaagtagctgggattacaggtacacaccaccacacctggctaatttttgtatttttagtagagacaggttttgccacattggctaggctggtctcgaactcctggcctcaagtgatctgcctgcctcagcctcccaaagtgctgggattacaggcatgagccactgtgcctggccaagaaaggctcttaaacatataaaaagttgcataacttcacagtaaaagaaaagcaaatgaaaaccacactgagtgacagataaatgcagtaagttaatcttgattggatcctggactggaagagatgcaatattttgggtaaattaggggaaattttagtatagactaatatattcaggggtcagtgatctttttctgaaagagccagataataaatactttggattttgcagaccttatggtctttgatttatctactgacctgttacagcacagaagcagatgtagataatacccaagtaatgagtgtggctgtgtttcaattaaacttaataaaaactggcagtgggccatacttggtcattcatgcattagatgatattagtaaactgatgttaaatatcttgtgtgttcagagatagtgagattgtggttatataggagaaaacatctaaagtaggtaggggtaaaatattgtgattgatgtctccctccaaaaaaattgtacaagtatatgcaaaaaaataaaaagccaggcaaagtggtaggtgcttatagttccagctactccggaggctgaggcaggagcattacttgagcccagaggtttgctttaaaaaaaaaaaaaaaaaaaaaaatatatatatatatatatatatatatgtctacacacacatacatatgtgtgtggggaggggttttataagaattggttaagctgagaggaggaggagcaagatggcagaatagtacccttcaaccatcgtcctcctgcaggaacaccaaattgaacaactatccatgcaacaaaataccttcataagaaccagaaatcaggtgagtgatcctagtacctggttttaacagcatctcaaggaaagaggcatcgaagagggtaggaaagacactcttgcattgcctacaccaccccttccctatcccctggcagtgtgcggagatagaatctgtgtgcttgcaggaggaagagcaaaatgattgtgggactttgcattgaaactccagtgctgtcatatcacaatggaatacaacacagggcagaattctgccagcacccatggagggagcattcagactagccccagccagaggagaatcttccgccccagcggtaggaacctgagttgcagctagttccaccaccagttgagtaaagtggacttgggtcctgaataaatttgaaaggcagtcaggccacaggactgcattcttttggcacgtcctggcactgtgctggggtcagagcctgtggatttggggtgcacacaactcagacaccagctctggtagtgaagggattgccactcccacaacttgaagcagtggagcttggggaggtgctctttccatttggggaacggagaggaaagagtacagaatattgtgtcttgcaacttgagcactagctgagccacagtaaaataaagcaccagtcattcctgaagcctccaattctaggccctagaccctggatggtatttatagccccaccctgggccagaagggaacctactggccctgaagggaagggcccagtcttggaagaatttaccacctactgagtaaagagcccttggaccttgaataaatatcagcggtcgccaggcaggagttgccacatgccttgggcaagacccagtactatgctgtgttcagttgtgacccagtccagtgccagctgtggtagccatgggagtgcttgcaccacccctccctcaactccaggcagcccatcatggagagagagactatttgggggaaagtgaaggaagagaatgagagatcgcctaataatctaggaaattcctctccatcttacccaagcacaccaaggtgagacctccaggagcctgcaagggtcacagtcttactgggcttggggctccctgtagtgcagatacggctgcagtgaccaaagacttagattacaacactcaatttcctttgaatacctggaaagccttctcaagaaggacagataaaaacaagtccaaactgtgaagatagaataaatacctaactcttgattgcccagacgtcgatgaacacctgcaggcatcaagaacatccaggaaggctgggcaccttgggtcacgcctataatctcagcactttgggaggctgaggcaggcagatcacctgaggtcaggagttccagaccagcctggccaacatggtaaaaccctttctctactaaaaatacaaaaaaattagctgggcgtggtggcgggcacctgtaatcccagctattcaggaggctgaggcaggagaattgcttaaacttgagaggtggaggttgcagtgagccgagatcatgccattgcactcaagcctgggtgacaagaatgaaactgtctcaaaaaacaaacaaacaaaaaaaacatgcaggaaaacatgacttcaccaaactaaaggcaccaatgaccaatctcatagtgacagagatatgcaacctctcagacaattgaaaatagctgttttgaggaagcccagagaatttcaaaataacacagagaaggaatttagaatcctgtcagagaaatttaagaaagagattgacttttttttttttttttaaagacagagtttccctcttgttgcccaggctggagtgcaatggtgtgatctcagctcactgcaacctccatctcccaggttcaggcaattctcctgcctcagcctcctgagtaactgggattacaggcatgtgccactatgcctggctaattttgtatttttagtagagacagggtttcaccatgatggtcggactggtctcaaactcctgaccttgtgatctgcctgcctcagcctcccaaagtgctgggatttgagtgaccacacccagctgagattgacatatttttttaaaaaaataagcagaggctgggcacagcgactcacacctgtaatcccagcattttgggaggcctaggtgggtagatcacttgaggcaaggagtttgagacaaacctggccaacatggcaaacccccatctctactaaaaatacaaaaattagccgggcgtggtgacacaggtctgtaatcccaggtatgcagaacgctgaagcacaagaatcgcttgaacctgggagacagaaattgcagtgagccaagatcatgccattgcactccagcctgggcaacagagcgaactctgtctcaaaacaaacaaaccccaacaaaacacaaaaaacaaattctggagctgaaaaattcagttgacaaactagaaaatacatcagaatctctcaacagcaaaattgatcaagcagaagaaagaattagtaagcttaaggacagactgtatgtaaatacacagaggagaaaaaagaatgaagcaaacctacaagatctagaagtcacagggcaaatctgagagttattggtcttaaagaggaggtagagagagagagagagggtagaaacttcactcagatagtaacagaactttccaaacccagagaaaggtatcaatattcaggtacaagaaggtcctagaacaccaagaagatttaacacaaataagattacctcaaggcatttaatagtcaaactcccaaaggttgaggataaagaaagaatcctaaaagcagcaagagaaaaggaacaaataacatatgaaggagctccaatacatctggcagcagacatctcagtggaaactttacaggccaggagggagtggcatgtcaagtgctgaaggaaaaaaacgtttatcctagaatatcatacccagcgaaaatatacttcaaacatgaaggagaaatactttcccagacaaacaaaagctgtgagggattttgtcaatatcagacctgacctataagagatgctaaggggagctctttaatctgaaaggaaaggacatgagtgagcaataagaaatcatccaaaggtacaaaactcactggtatcagtaagtacacaagaacagaatggcttgacacactaattgccgtgtgtaagccatattttgagtaggaagactacaaagcctatcaaaaattataattacaattttttaagcgataatataaaaagataaatagaaacaatggccgggcacggtggctcacacctgtaatcccagcactttgggaggctgaggcaggtggatcacgaggtcagatcgagaccatcctggctaacacggtgaaactctgtctctactaaaaatacaaaaaaattagccgggcgcggtggcgggcgcctgtagtcccagctactcgggaggctgaggcaggagaatggcgtgaacctgggaggcggagcttgcagtgagccctgattgtgccactgcactccaagctgggcgacagaacgagactctgtcaaaaaaaaaaaaaagtagaaacaacaaaaagtcaaagagggggatggagtttggagttaaactgtagagttctgttttcgttttctcttgactttttttttttttggtaacgagttatcagtttgaaatagttgtttataagatgttgtttgcaagcctcatgaggcttttattttgaggtaaccatgtaacctcaaaacaaaaaatctacaacaggtatacaaaaaatgaaaagcaagaaataaaactatactaccagagaaaatcatttcaacgcaaagaaggaagggaggaagggaagaccataaaacaagtagaaagcagataacaaaatggcagtaggaagtccttacgtatcaataataacattgaatgtaaatggactaaagtctctaatcaaaagacacagattggctgaatggaaagaaaaataagacccaaccatatgctgcctacaagaaactcacttcacctataaagatatacacagactgaaagggctggaaaaaccagaactcctctttttccatacaaacagaagccaaaaaaagagagcagagtagctatacttaatgtcaggtaaaataggtattaagataaaaattattaaaaagagacaaggtcattatataatgataaaaaggtcagacaatataaaaattatgtatgtgtgtatctatctatctatctatctgtctccacacatacctaacactggagcacccagatatataaagcaaatattatctgagctaaagagagataccatcacaaagaaggcaagaaaacaaacaaaaacggaaaagagccagagagagagagagactcaacaatgcaataatagctagagacctcaacaccccactttcatcattggactcaaaatcaacaaagggccaggtgcagtggcttacgcctgtaatcctattagtttgggagactgaagtgggtggattacttgaggtcaggagttcaagactggcctggccaacttggtgaagccctgtctccactaaaaatacaaaaattagccaggggtggtggcaggcacctgtagtcctagctattcgggaggctcaggcagaagaatcgcttgaaccctagcagcggaggttttgttgagccaagattgcaccactgcactccagcctgggctacagagtgagactccatctcaaaacaaacaaatgaacaaagaaacgtgaccaaccaggggcggtggctcacgcctgtaatcccagcattttgggaggctgaggtgggctgatcacatgaggtcaggtgttcaagaccagcctgaccaacatggagaaaccccgtgtctactaaaaatacaaaattagctgggtgtggtggagcatgcctgcaataccagctacttgggaggctgaggcaggaaaatcacttgaacccaggaggcggaggttgcagtgagccgagattgtgccattccactgcagcctgggcaacaagagcaaaacttcatctcaaaaaaaaaaaagggagggatcaagattttttttttcttagtatacttttcttttccaatttcattgctttggcaccattatagaaagtcaactgatcatatatgtgtaggtctacttctggattttctgttctcttacaatgatgcctattttttatgttaacactacacagtattactgtgtcttcatagtgtgtctcaaaatcactgtgagtctggcagctttatcctttttccagattgttttggcaattctgagtcctttgcattttcatataaactttaaaattagtttgtcaaactctgttgtttagtaagcatgctggaatgattgggattgtgtttatacattagtttggggagaatggacatctaataatagtaagcctttcagtgtatgaacatggtatatatctttgcatttattttttctcagtattatctgtaatttttagtgtatacatcttacatatacattcttgttaaatgtatccttaagtatttcatgtttctgaattggctatgaacagaattttaaaaaatattatcttctagttgtttgtatatagaaatacagttgatttctgtattttgactttgtatcctctgaccttaccaaagtcatttattacttctaggagcttttttgtatattctgtgaaattttcatagacacttataagtagtgacagttttatttcattctttgcaatctgtatgccattttttccttgccttactgcactggctaagactggctgcagtgttgaatagaagtaatgagagaggacatctttccctagttctcagtcttggaaagcattcagtttttcactactgtgtatggtgtcagctgtaggctttcctattattcctattttcctgagagtttttaatcataagtaaatactgaatttcatcaaatgcttttcctgcatctaagcagatgaacctatggtttttcttctttattctgcgaatgggacccaaactgaaggagcagcacctttcctgagacatggcagtctcacatggtagctctgaaagtttcaatctgatcgtgacataacttcacttctgcttattacatccttttgattaaagcaaatcacatgacaggactacacttctctctttgggagggcagagaagtcacatggcaatgggcaagtctgtataatcttctcacagggagggcaacaaataattggggtcagtgatacaatctgtcatgcacattgttcttaattatgtgtacaggttaaatatcccttattcaaaatgcttgggactagaagtgttttgaactttggactctttcagattttgtaatatttgcatatatataatgagatattttgggggtagaaccaaagtctaaacacagaattcacttatgtttcatattcaccttagatgcatgccctaaaggtaatttacaatattcttagtaattttgtatatgcaacagtttatgtacattgacccatcagaaagtaaaaatgtcactacctcagccacccctgtggacagtctgtggcatcatgtcagcactcaaaaagttccagattttggaggatttcaggtttttgggttagagttactcagcctgtataaagctctatgtatgtctat

SEQ ID NO: 30 - DNA, 88627 bp, Homo sapiens
gggagttgattaaattaggaaacattcatataaggcaatatttacttaagccattacagtaattttatagatctaggtagttattagtaatgatgacctgggataatttgtttttttggtttttatttttgagacagagtcttgctgtcttgtccaggctggagttacagtggtgcaatcttggctcactgcaacctccacctcccatattcaagcagttctcctgcctcagcctcccgagtagctggaactacaggcatgtgccaccacacccagctaattgttttttttttgtatttttagtagcgatggggttttgccatgttgcccagcctggtctcgagctcctgagcccaggcaatccacttgtctcagcatcccagagtgctaggattacaggcatcagccaccatgcccagcctaatttgtttttgtttgtttgtttgtttgtttatttttgggacggagtctcgctctgtcgcccaggctggagtgcagtggcgcaatctcggctcactgcaagctctgcctcccgggttcacgtcattgtcctgcctcagcctcccgagtagctgggactacaggcgcccaccaccacgcccggctaattttttgtattttttagtagagacagggtttcaccatgttagtcaggatgctctcaatctcctgacctcgtgaccggcccgccttagcctcccaaagtactgggattacaggcgtgagccaccatgcccggccttggtttttttttgttttgttttttgttttttaagttttaacaaatctcattttttttaatgatatgtatgacttgaaaaaaatttgagaaacctaaacaggatggtcaatggtgaggttgtggttatttttaattattaacattgttttattttttaaagcaatatgggctgggcacagtggctcacacctgcaatccagcactttgggaggccgaggcaggtggatcatttgaggtcaggagttcaagaccagcctgaccaatatgatgaaaccccacctctactaaaaatacaaagattagcaggtcatggtggtatgcatctgtaatcccagctactcgggaggctgaggcaggaaagtcacttgaacccaggaggcagaggttgcagtgagccaagattgcaccactgcactccagcctgggtgacagagcaagattccgtctcaacaaaaaaaaacaaaacaaaagcaatatgtattgcatttataaccgaagaaaaaccaaaggtgaatctgatttcagaaaagtaacttaaggaaatgtaacatctaaaaataagaggaaagtatcaaatctaaatttaaatgggataatgataaccccagtttagtatttatggtgattttctttaaagaagaaagaatcccttagactttatggagtgctctgtgaccgtgttgagctatcttaagtggatcaaagatgttcttctatttttaggccttgtacctaatagcaactaatggaaccccagaacttcagaatccagagaaactttccccaatatttcgggatttcttaaatcgatgtttggaaatggatgtggaaaaaaggggttcagccaaagaattattacaggtaaatttaaaaatgatttcatttgggggaatagttgacttttttggtaaccgacagaaagctttcctagggctaataagtagatttcactactcattgatcaccagcggtatggcagctgctgcaatttagggtttcatcctaccatgctgagcaaactaccgcaaggacagaaaaccaaacactgcatgttcccactcataggtgggaattgaacaatgagaacacctggacacaggaaggggaacatcacacaccggggcctgttgtggggtggggggagtggggagggatagcattaggagatatacctaatgtaaatgatgagttaacaggtgcagcacagcaacatggcacatgtgtacatatgtaacaaacctgcacgttgtgcgcatgtaccctagaacttaaagtattaaaaaaaaaagtgagggtttcatctgctgtgaataaaattctgacaaaaccgtaatgtgcagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcactcctcagacctgtttattgctgttgtgtgtatatttgtcaaactaaaatgattctgctttcattcaactctgaaagtaatgcgttgattatgttagtcttatgaaggtattaatatgtgtttagtttattaaattatgatcgacaagtagtctttggggcttaattgaacaaaattattttgtttctaacctgatgaatggcacttatacatttatttttccccttctttctggcagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaaccttttaatggtgttgtgccatcattttgaatttattacaaagctccaaagtaggaaggtttctagaaatgtgtgggcagtaaacatgaagttttccttttttttttttttttttttttttttgagacaagtctcactctttcttccaggctggagtgcagtggcgccatctcagctcactgcaacctctgcctcccaggttcaagtgattctcctgcttcggcctcctgagtagttaggggaagttttccctttctaaatcaagttcagaataattttctttatcaatgtttctctatcagacccagggaaacagttctgatttgaacacacaccttgctggagtaataaaaacctgatcagaatttctgtgttaagtgaaccaagaaaccttttagagtgcaatacgtcgtaaggcatcacttcattatgtgaattaatttggaatcttaggtaccctaacatagggaacagccacaataatggtttactatcaaaaagcataaaataaggccaggcgtggtggctcacacctgtaatcctagcactgggaggctgagactggcggattgcctgagctcaggcaggagaccagcctgggcaacatgatgaaatcccatctctactaaaatacaaaaaaaaatcagccaggtgtactggcacatgtctgtagtcccagctacttgggaggctgaggcacaagaattgtttgaacccgggaggtgaaggttgcagtgagacaagatcatgccattgcactccagcctgggtgacagagcaagactcctgtctcaaaaagaaaaaaaaaaaaaaaaaaaaaaaaaaaaaaaaaaatatatatatatatatatatattctgggtgagaaggggaggcaatgactttgaaatgtatttgttacactatatggctgtttcgtcttgttctaacatttatatttctttgaactaatagcaaatgctcaaagcattgcctaagaaaacttttaaaagcctgtggttaatttcagaagctctatctctagggcttggcgggaggatggctcgagcctgggaggcagaggttgcagtgagccaagatggtgccgctgtactccagcctgggtgacagagcaaggcccctgtctcaaaaaaaaaagagttggtaattgcctatatctctataaagagaattttatagtctcaataatcctgattatagctgttttacccatacatcttagtttggggttagggaaaaagactaaaaatgctgcatttctgggaaacaatttgttcagaaaatgacagcatttatataaacttgtgagttacgtgaagagactgctgatcttcgccgggcgcggtggctcccgcctgtaatcccagcgctttgggaggccgaggcgggcggatcacgaggtcaggagatcgagaccatcctggctaacgtggtgaaaccccgtctctactgaaaatacaaaaaattagccgggcgtggtggcaggcgcctgtagtcccagctactcgggaggctgaggctggagaatggcgtgaacccaggaggcggaggttgcagtgagccgagatcgcgccattgccctccagcctgggcgacagagcgagactccgtctcaaaaaaaaaaaaaagagactcctgatcttgaaaggaatgacgcccgtggatacgtcatctctggatagttgttagaaggtgcccgttgcattccctcgttcatccgtcccagtttgctctggagcagatgcaaacgtctcaccctcgtagtgctgtaacaggccagatagagtgacagtgccagatagagtgacagtgccatacatttctgtttttcattcttagacctgtaggtatgtacagcacagcatcatcaacgcgttgccaaaaaactattttcctccaattcttaataaactacttcactttgacttctatatttaaaatagaagtatagggccaggcgcagtggctcacacctgtaatcccagcactttgggaggccgaggtgggtgtatctatcacctgagggcaggagttttaagaccagcctggccaacatggtgaaaccccgtctctacttaaaatagaaaatgagccgggcatggtggcgggcgcctgtaatcccagctactcaagaggctgaggcaggagaatcgcttgaacccgggaggcagagattgcagtgagccaaaatcacaccattgcactacagctttttgagactccgtctcaataaaatagaagtgtaccattttcaaaacctagttgatcacggccataaaattaagtaatatctaacagtacaatccaactgtgattgctttaatatattgtcagtaaaatctttaaggagtttcaggattgaaactagaagacatcttagtcacattcaatattccttacattttagtacactttacgatttgctgctagtatctttgttgagctgtttttcagtaaactaaaaatcttaatcatttgaggttttagtatagatactgtcactgttttgttcacactcttggtgctgtaggagtgtaaatgaccatctcatttgttcatctgttcatgctctattggagcatgccgtaagactgtggtgtcattgaaagtgacctttggccatggactgttggatatgtggatcagctactttcatataacttgcattgtcagcaaatacttttccacttcccttcagccctgcgtattttaccacggataaacggtgttccattatgcgcctgctctgtcccatttccgtagtgtcttttttttatgacaaagcacagctggtcaaggtgttatcatgggtctgagtgcacgagtgtttgttgctgcacgttccccatccagtcactaagcaagacacagaactgtatgaaagcttatttttacttagtttcatcttagagtcacatttgaacttgtgagtttcttttaaatgaaactgtgtttaattttgagatttgctgctagggggaggactccttacgctttttgaagttagtaacagccctctctagtagaatgtgcacaaaaacggttaatgtgaattggtgggcttgtttctgtgctttgttttgagtgataatacaagggcctacatcatagggggttttcagggttaaattcattcatttcaaataaaatatttagaatgatgtctagcacaaagtcaacatttgataaatgtagtctcctctcattgcttttttcccctctgatattgcgggagcagatgcagaagtaacaggatgctgcacagagctatttgcacttttctcccatctctcgtatttaaaaaatggatgcattatggaaattatgctgcaaatattacacagcttttttttttttttttctaacacaggatctcactctgtcgcccaggctggagtgcagtggcacaatctcggctctctgcaatctctgcctcctggattcaagcgattctcctgcctcagcctctgagtagttgggactacaggcacgtgccattaccgcccagctaattttttgtattttaagtagaggcggggtttcaccatgttggccaggctggtgttgaactcttgacctcaagtgatccacccgcctcagcctcccaaagtactgggattacaggcgtgagccaccacgtctggctgttccacagctttacacaaagaaggcccccagtacatccctatttggtcacacagtgtgaaattgtgtattttacagtattgcatagttggcaatatgagactgtgcattgtagtttggataatcacttccctgaagggatattgcagataaaaaagtttaatttgagaattggttcttgaagtttttgtttgttgttttttgagacagagtctcactctgtcacccaggctggaacgcagtggcatgatctctgctcactgcaacctccgcctcccggattcaaacaattctcctacctcggcctcccaggtagctgagactacaggagtgagccaccacacccagctaatttctgtattttaagtagaagcaaggtttcaccttgttggccaggctggtcttgaactcctgacctcaagtgatccaccacctcagcctcccaaaatgctgggattacaggcgtgagccaccacacccagctgttacagagctttacacaaagaaggcccccagtacatccctatttggccacacattgtgaaattgtgtattttacagtattgcatagctggcaatatgagactgtgcattgtagtttggataatcactttcctgaagagagattgcaaagaaaaaaatttaattcaagaattggtttttgaagtttttgtttgtttgttgttttaaatagagacaaggtctcactatgttgcccaggctggtctcaaactcctgaactcaagtgatcctcccgcctcggcctcccaaagtgctaggattacaggtatgagcgaccacacccagccaagaattgttttatgtatctattagaaataagtttgtaaaccacaggttccaaagtgttagtacctttaatgtaacaggaagttcagtgtttgtcagtctggggttgtcctgggacaaccagggagtccagcaaccccaccagcacttgggactccacgttgtcactctatcattcttagcatgtaggcctgtatccttaatgcctgttgcaacatagatactagatggctggtgcacctccaacctcttgtccgggtgtcaagcaggagaaagagagatggcaaaaggcaacgtggaaagcacaagggagtagtgcttatatcgagagaacacaaattttcccagaaaccctcaacttctgtcccactggccagaactgtcatttggcacctcatagctgcaagagagtctagggaagagtgtttctccagataaaatgagactcgttagtgaagaaggagggatggaaatagtatataattgtgactactatagtttgagtgtgaaaattgctctattggaatttttttgtagctcttcccctactatttctacagagcactgccccgtctgttgactcctttgatactacatggttgatggggtgctcacttttagatatgagaaaaggggctagagcattaatctcttcagtgttatccaggtagaatttcagctcttctgggttaaggaactggaaacttttcaactctctaggcctcatctcagctagagagctagttttgaagaaacgtaattgcttatgaagtcataaatgcagtttaaatgtaattggcagtgttgcaagtttagtgatccatcgtgggaggagaccacaagtatctgctacaaattcctgattgagcaattgattgatttagtttagcaggagcctaggtgaccctgagcaaatagtccttcatgggtgttcctggcccctaagtgtcctctagggggtgctgctcccactgtcatgctcctcaaagatggagcctgccagaggtgaaagcccaattcctgccattgccctgctatcctcgggtttatgtcccattctggaagaactcaaatgtaacattattcaatgttacaagcagtctcactgttcagaaacatggagttcttttggttcttgagtcaaacttggtatcagcaaagctacattctcatagggagagaaaacaagtctgggtgtctccccaacttcctagtgctccagagagcctggctccctgtaataattcttattcttaaaaaaaaagtaactacataatagagaaatacattctgatttataaaatttcagccattcagacaaaagaaagcctcttcaatcccagtccaagtccccgttccaaaggaaatctcttactagtttccatcttttcagacctttctctttgcattatacctagatactggtcagttttgtagaccaagcagttcttgaaggctgcaatcaaagacaatttatgtttgtttccctctcttctaacccattttacaggggtagttcttccccattccctggatgaaatttagagcaaacacccaggcagttttaccaatgagttctaagaatattcaaagaaaaaattccaatcctgcacaaagtatttgaggatatagaaaacattccccaaattctattataaggatggagtagccatgataccaaaataattgaagaagaaaattataggataggccaggcgcagtggctcacaactataatcccagcactttgggaggctgaggcaggtggatcacctgaggtcaggagtttaagaccagcctggccaacatggtgaaactccctctctttagctgggcatggtggcatgcacctataatcccagctactcaggaggctgagacaggagaatcactttaacccaggaggtagaggttgcagtgagccgagatcgtgccgttgcactccagcctgggcaacaagagtaaaactccgtctcaaaaaaaaaaaaaaaaagtataggataatctcataaatacaaatgtgcaattattaaatatattactagcaaaccgaatctagcaatgtatgaaagaggtagtgcatcctaaacaagtaggcttatgcatgtaaaaatcaagataatttacagtattagtagattatctgggcatctcaacagattaaagagagtggctgagcccagtggttcacacctgtaatcccagcactctgagaggacaacacaggagaatcacttgaggccaggctcaagaccagcatgggcaacatagtgagaccctgtctctaaaaaacctaataaaaaaacattagccaggtatggtagcacacctatagtcctggctactctggaggctgagctaggagaatggcttgagcccaggagttcaaggttgcagtgacctgtgattgcaccattgcactccagcccacatgacagagtgacactgtctcttaaaaaaaaaaaaaaaaaagcattggctgggcacggtggctcacgcctgtaatcccagcactttaggaggccgaggtgggtggatcacctgaggtaaggagttcgagaccagcctgaccaacatggtgaaaccctgtatctactaaaaatacaaaaattagccgggcatggtggcatgtacctgtaatcccagctactcgggaggctgaagcagcagaatcacttgaacctgggaggcagaggttgcagtgagctgagacctctccattgcactccagcttcggcaaaaagagcaaaactccatctcaaaaaaaaaaaaagcatttagtaaaattcagtatcaattcatgattaaaaatatatattttagcaaattaggagtgaactttttttttccgagatagagtcttgctctgttgcccagactgcagtgcagtggcatgatctcagctcactgcaacctccgcctcccaggttcaagcaattctcctccctcagcctcccgagtagctgggattacaggtgtgagccaccacacctggctaatttttgtattcttagtagagacggggtttcaccatgttggccaggctggtcttgaactcctgacctcaggtgatccacgtgcctcggcctccgaaagttctgggattacagtgaagccactgtgccagccaggagtgaactgaatcacttgaacccgggaggctgaggttgtggtgagccgagatcacaccattgcactccagcctgggcaacaagagcgaaactccatctcaaaaaaaaaaaaaagaatttgaaagcaatggctgggcacaatgactcacggctataatcccagcactttgggaggccgaggcaggtggatcacctgaggtcaggagtttgagatcagcctggccaacatggtgaaacctggtctctactaaaaatacaaaattacccgggcgtggtggtgggcacctgtaatcctggaggctgaggcaggagaatcacttgaacctgggaggtggaggttttagtgagccgagatcacgccactgcactccagactgggcaacagagtgagacttggtctcgaaaaaaaaaaaaaaaaaaggaattggaaagcaagataaaatctcattattttcagataaggttgatatgataaactattaaaattaagaaatttagcaagtttgctgtatgcaaaatcagtgtgcaagagtctattatattgctaagcactagcaacaaatagaacacataatcttaaaaatctaccatttataacagatcaaaaatacaaagtacctagaaatggtcactcctgtaatcccagcactttggatcacctgaggtcaggagttccagaccagcctggccaacatggtgaaaccccatctctacaaaaatacaaaaattagttgggcatggtggcgtgcgcctgtaatcccagctactcaggaggctgaggcaggagaattgcttgaacccaggaggcagaggttgcagtgagccgagatcgcaccattgcactccagcctggggtgatggagtgagactctgtctcaaaaaataaataaataaacaaaaagggaggattttactgaaagattttaaatgttggattggaaactattttatggatagttgaaattgcacttcaaaagagaaacaatttaattcaatttaagccagataaatgaaacattggttcaaagtcagaaatacatagtcctctaaattttagtataaagagacactttacagaagccataaagtagcctgtagaggccagcaccggggcttatgcctgtaatcccagcactgtgggaggctgaggtgggtggatcacctgaggtcaggagttcaagaccagcctgggcaacatggtgaaaccctgtttctactaaaaatacaaaattagccgggtgtggtggcgcactcctatagtcccagctacttgggaggcttaggcaggagaatcgcttgaacccaggaggtggaagttgcagtgagctgagatcatgccattgcactccagcctgggcacaaagagtgaaactccatctcaaaataataataataataataataataataataataataatattcaaaaaggagaatagttgggaagcctataaatttcagcctatcctaattcagggatcctgcttctaggaggaagaaaaaaaggcatccaatagagatgaatgaacgttgtataccccctttgcctccttttcaggataatttagtgcaaactttaatactcgccattcagatgctcttcagtcataactcctaaacatgctgagggcctgttgtgtgtctgaattagtggatagggaaatgaggcacaaaaggcaattttgaagactggcctctttcagaattgcagagtttggtggactttatttttttctttttttggggggtggggggcgcaatctcactctgtcacccaggctggagtgcagtggtgtaatcggctcactgcaagctccgcctcccaggttcaagcgattctcctgcctcagcctccccagtagctggactacaggcgcccaccaccatgcctggctaatttttgtattttcagtagagacgtttcagcatattggccaggctggtcttggactcctgaccttgtgatccgtccgccacagcctcccaaagtgctgggattacaggtgtgagcccctgcacctggcctttggtagactttatattgaggagcttttgtggctgagtaaactctggacttttggaaggagaagaggtagaaaggtgttcatggaaagggacccaatcccccaggagagggttcttggacctcatgcaagaaataattccaggggagtccacggagtaaactgaaagcaagtttattaagaaagtaaaggaatagggccgggcggggtggctcacacctgtaatcccagcactttgggaggccgaggcaggcggatcaccaggtcaagagatcgagaccatcctgccaacatggtgaaaccccatctttactaaaaatacaaaaattagctgggagtgttggcatgcgcctgtaatcccagctactcgggaggctgaggtaggagaatcacttaaacccgggagcagaggttgcagggagccgagactgtgccattgagctcctcctgcctgggccacaagagcaaaactccgtctcaaaaaaaaaggaaaagaaaggaatagagcacgtctgctccataggcagcgcggcagcttgggctgcttgactgaatatacttacagttatgctaaacaaggggtggattgttcatgagttttccaggaagggggtgagcaattcccggaactgaggattcctcccctttttagaccatacagtgtaatttcctgacgttgccatgtcatttgtaaactgtcatggtgctggcgggagtgtccttcagcagctaatgcattataattagcgtctaatgaacagtgaggaccaccagaggtcacctcattgccgtcttggttttggtgggttttggctggcttggtaacacatcttgttttatcagcagggtctttatgacctgtatcttgtgctgacctccaggcctcagccttattttaaccagtccttattcaagatggagtcactccggttcaaacacctctgacaaagggataaagaaaaacgtggtctgcagattgttgcaaatgaacctaagccaggtttgatcatgcctcatttttgtttggttgtttttttcctttttttttttttttttgagacagggtttcacactgtcactcgggctggagtgcagtggtgcgatctcagctcactgtaaactccacctcccaggctcaagtgatcctaacacctcagcctctcaagtagggactacagccaccacacccggctaatttttgtgtttttttgtagacgggtttcaccatgtgacccaggctggtcttgaacccctagcctcaagtgatccaccgcttcaaccttctaaagtgcttggattacaggtgtgagccacctcacccggacatgcttaggttgtttctgtaaagttatagctacctatggagtttgaggtggtgagggttaactaacttctgacaacccccctgccagattataatgaaagcaagtcgcagaccaaatcttgtcacacacctgaaagctcatttaagcaaacatttgtcagcaaaagtgtttgttcagcctatcctgtagctcactataatccatgctctctgtcccaaatgctctgtccacaactttgcatgaaaagttcacttgaggcagagagggaaacgtgccaggggccaggattctgttacccttaaagatggcatcatgtaaccagacatcctcttaactagtggctggtcacaggattatgtaacgatggagccctgagggccattcctaaggggtcgcgttgctgacctcactagattcttacaccttgtttatgcaaaggcagcaggagtctctcaaataactttagccaatggaaggatcccgaacacctttcatttcactgatgagagcccactgatgacctcattaccaattaacaagcaactcagttcatcaggaaacagccatttctttttccatttatttatttatttatcgagacagtgtctagctctgctgcctaggctggagggcagtggtgtgatcatggctcactatagctttgacctcctgggctcaagcaatccttccagttcagcttcctgagtaactgggagcagagatgctcgccactacagctggctactttttttattttttgtacggatggggtctcactatgttgcccaggcttgtgactgcacaatgggttccccttgcccgttgcctaggcagaactgatacctcacgacaggggaactgcagtacagaaagagtaattcacgcagagccggctgtacaggagatcgcggttttattattattcaaatcagtctctccaggcattgggggatcagtgtttttaaggataatttggtgggtgggggaaggccagtgagagagtgttgattggttgggccggagaggaaatcatgggaaattgaagctgtcttcttgcgctgagtcagttcctgggtcggggccacaagatcagatgagccagtttatccatctgggtggtgccagctgatccatcaagtgtggagtctgcaaagtatctcaagcgctgatcttaggagcagtgtagggagggtcagaatcttgtagcctccagctgcatggctcctaaaccatcatttctaatcttgtgactaatgttagtctagtcccccggcaagaaggaggtctgctttgggaaagggctgttaccgtctttgttttaaactataaattaagtttccccccaagttagttcagcctacgcccaggaatgaacaagggcagcttggaggttagacgcaagatggagtcggttaggtcggatctctttcactgactcagttacaattttgcaatagcggtttcaggctgatctcaaactcctaggctcaagtgatcctcccgcctcggcctcccaaagtgttgggattacaggtgtgaacccccacacccagccaaaaaatctatttctgatcatcactcagcttgttaactgagcctcaggcgttgattgagatgtagataatagaaatgcttgcagtactgcactccagtctggaacaacagagcaagaccctatctcttaaaaaaaaaaaaaaagtgccagtagtagctgcctctagtgtgtaagtaacctttctgactagacactggctacccttatgtgtgaattttctttctttcttttttttttttgagacggagttttgctcttgttgcccaggctggagtgcaatggtgtgatcttggctcaccacaacctctgcttcccaggttcaggcaattctcctgcctcagcctcctcaaggctcacttgaacccgagtagctgggattacaggcatgccggctaattttgtacttttagtagagatggggtttctccatgttggtcaggctggtctcaaactcctgacctcagatgatccacctgcctcggcctcccaaagtgctggaattccaggtgtgagccaccgtgcccggccttcttcttctttttttttttttaagacagagtctcgctctgttgcccaggctggagtgcagtgacacaatctcagctcactgcaacctctgcctcccaggttcaagcaatttccagcgaatttttgtatttttggtagagacagggtttcactatgttggccaggctggtctcaaactcctgacctcaagtgacccagccaccttggcctcccaaagtgttaggattagaggcgcgagccactgcgcccggcctgaattttctaataaaacaatgcacgccatctttgctaaaatcttttaaagtaaattgcaggcatcataatagaagttggttcttaatatttgtagtttaactgcttattagcagtaatttgtagttgcttgtaattttactaaggtaggaatttaattttgtgacctagaagattgatgggtaggaaggaggatcacttggcttagtaaatgaagttagccagtcactcttcatccaaactttcttcttggcatttaagcactaattcccattaatgttcaacttaaattttcagttgaactttagtgattttttgggggggaacattatgttatttagggctatttgggaatttatgatggtatcaggatgtcacaggtttattgtgccataaaattttgcctatggcagactgtgcctccagtcttagtcccagaagttaagtcaggtgtctttacctctaagattccagtttaaaaaagaaagaaaaaataaataagatacaatacaggccgggcgcagtggctcacacctgtaataccagcactttgggaggccgaggcaggatgatcacaaggtcaggagatcgagaccatcctgactaacacggtgaaaccctgtctctactaaaaatacaaaaatattagttgggcgtggtggcgggcgcctgtagtcccagctactcaggaggctgaggcaggagaatggtgtgaacctgggaagcagagcttgcagtaagctgagatcacaccgctgcactccagcctgggcaacagggcgagactccgtctcaaaaaaaaaaaaagatacaatacagttccaatttagagctgggcattgtggttcacacctgtaatcccagctacttgggaggccgaggcaggaagggaggattgcttacacccaagagttagagaccaatgtaagcaacaaattgagatgcctgtctctaacgacaacaaaaaaatccagttcagtatggctaaattatacagtccatgtcctgtgatgcttacatgagttcttggggtcacgacattagccccattaaatgttccacaaggccatgagcattttttcgaagacaaaatattttaaggactagagtctttaaaggatttttggctctgtcagtctcacgctgtcacccaggctggactgcaggggcacaatctcggctcactgcaacctccgccttccgggttcaagtgattctcctgcctcagcctcccgagtagctgggattacaggcacctgccaccatgcccagctaactgttttttagtagagacggggtttcaccacattgaccaggttggtgtggaactcctgacctcaagttatcctcctacctcggcctcccaaagcgctgggattacagatgtgagccacggcgtctggactgtttgtaaactttttgccaacattttggatgaacgctgcttattcctgtgaatcaaggggtgatctcctgcagcctggaagaaacaaaaagggatgggtagtaaaaatctggatcaatatactagttccggacaattatcctgcaaattctgccaggtaatgaaagtgagtagggtctccataacctggaggtttctttgttttggaaaataaaaccaagtaacttcataacccccaggggaaaatttttatatcttggcaagtaaaattttagatggaaataatctactatgccacccttgcaggaattgctattctcactctactatttgtagtagagctatataacagtagcactttctaattgaattttttttttgagacgttgtcttgctctgttgcccaggctggagtgcagtggcacaatcttggctcactgcaacctctgtctcccaggttcaagtgattctcctgcctcagcctcctgagtagctgggatcacaggcacctgccaccacgcctggctaatttttgtatttttagtagagacgaggttttaccatgttggccaggctggtctcaaactcctgacctcaagtgatctgcccaccttggcctcccaaagtgctgggattacaggtgtgagccaccatgcccagccatgttttgctcaattattatacctatagcagggataatagttaccaacaaaaaggaagcatgaaaattttactatcactgagtctgctagaacttcttattgggtttggtaatatgtcacaccctggctatgcaaagaaggttataaaagaaagagattttatgtaagaaaggaccttgtatggtaaatactcgtcctaaaaagaatagttggttgtttttgttttgttttgttttttgagacagagtcttgctatgttgcccaggcttaagtgcactggcacaatctcagctcactgcaacctccacctcccaggttcaggcgattctgctgcctcagcctcccaagtagctgggattacaggcgtgtgccaccatgcccagctaatttttttttttttttttttttagtagaaatagggtttcaccatattggccaggctggtcttgaactcctgatctcaagtaatacacccgcctcagcctcccaaagtgctaggattataggtgtgagccactacacctggcctcgttgtttaaaaaaaaggatgttcaagacaagtcggaaagtttaagcatgtcttagatggtctgtggaagtcatgaagggattcataatttaggaattatgcaggaaagatttagccaaagttaacactaaagttaccctagccacccaaatccagtgccacttatcctaaaaggaatgttacttttattttgttatttttactttttggccaggcacagtggctcacgcctgtaaccccaacactttgggaggccaaggtgggcagatcacttgaggtcaggattttgagaccatcctggccagcatggtgaaaccccatctctactaaaaatttaaaaattacctgggcatggtggcatgtgcccataatcccagctacttgggaggctgaggcaggagaattgcttgaacctgggaggtggaggttgcagtgagctgagattgcaccactacacaccagcccaggcaacagagcaaaactccatctcaaaaaaaaaaaaaaaaaagaaaaagaaaaaggaatgttgcttttatattaacatttcagcaacatctggtggaggcaagccagtgttagaacccatcagagtggctgacagcagtcaaactccaaacgctgcttcagacagaaccacgcatggacacgcctttcttccgaggacccttagattggccccaggaggagccctagctgctgttccccacgcagtgccccttttcagcaagaagcagccggaaagagtctttatccaacacccgctaacaatagttagggttacaccactccagagcgggggaatgatacaggagttaagaagaaattacttaggcagatagtgagggtatggaagtcttcagtaaggttttccttttagtgaaaaacagccccaaatcattttcctttctaacaaagaacagcctgtaaaattgagctgcagacatacatgccagcagttgtgccaatcatgttcgagatggcggctccctcttcccttctctgccagccacgtgtacagtaaggagcagacaagatggcactggccaaggggacagttcgcttgcataatgagattagggtggggcggccagccttccccgcacattgtgtaaatatcatacctaattgaaccaatctgtgagccccatgtaaatcagacaccccctcctcaagccagactataaaatccagcacatctgctgctggccagacttttcctctcgttaagtcccctctctctcactagagagagagctgttttattttctctttcttttgcctattaaacctctgctcattcacttaaggtgcttagcacagtgtctgtaaatagaaatccctcaaaacatattcgttattatttttaactttattttaagataatgttatttatttatttatttattttattttattttatttttttttgagtttcactcttgtcacccaggctggagtgcaatggcgtgatctcggctcactgcaacctccacctcctgggttcaagcgattctcctgcctcagcctcacgagtagctgggactacaggtgcccaccaccacccagctaatttttgtatttttagtagagatggggtttcaccatgttggccaggctggtgtcgaactcctgacctcaggggatcctcccgcctctgcctcccaaaatgcagagattacaggcgtgagctaacatgcccggtcaagagaagagttaactcttaaaaagactgttatcatgtcagataagaacagcaactttgtagctttctgaaccctctcaacttgccatgcagaataccacagccttaccagatggacatggcagatgaaggagttcaaaacagtggagcagctagaaacttaaaggatcaattctagaaatgagaaagtcacagttgggttggattcaaaatctgagtataaactctgcctaaattcctggctggctggccatactacaaaatgtacacaggagctccagggacccctacaaaatggcaaggaggaactgagtgggggccaggggtgggggcacccgggatcctacctcaaagacagaagtgatcctggtgagatttatgagttttatactgagtctgttcctcaacccacacacaattcaggtggcaaaaagtgaaagcattattggcttgaagggtcctgagacagaacttggggctcataagacaacatgaaatgtagagggtgtgccccatgcacaatctgttacccctcagctcgaaatctattattctttgccctgtaaggcataagaagaggtaggttcgcttcctggttcctgtgtactttcttcccctgtgatatgactcccagaagcactcaggaggatcagtggtgcttattctctctctctcttttttttttgacatggagtctcgctctgtcgcccaggctggagtgcggtggcgtgatctcagcttactggaacctccacctcccaggttcaagtgattctcctgcctcagcctcctgagtagctgggattacagtcacgtgccaccacgcctgcctaatttttttgtatttttagtggaaacaaggtttcaccgtgttagccaggatggtatcgaactcctgacctcgtgatccatctgcctcagcctcccaaagtgctgggattacaggcgtgagccactgcacctagcctttttttttttttcgacagagttttgctctgtcacccaggctggattgcagtggcacaatcttggctgactgcagcctccgccttccaggttcaagcaattctcctgcctcagtctcccaagtagctgagattacaggcgtctgccaccacacctagctaattttggtatttttagtagagacgggtttttgccatgttggccaggctggtctcgaactcctgacctcaggtgatccacccgcctcagcctcccaaagtgttgggattacaggcgtgagccagtgttgggattacaggcatgagccaccacacccagccctagacagggtaattatgtaagaaaaagaaataaaaaatatccatattgaagagaaagaaataaaactttgtcaattaacagacggcatgaccttgtatgaagaaaatcatggctgggcacagtggctcatgcttgtaaatcccagcactttgggaggctgaggtgggagaatcatttgaacccaggagttcaagaccagcctgggcaacatagggagaccccatctctactgaatgaatgaaagaatgaatgaaggagcaagccaggtgtagtggtgcacgtctgtagtccccgctactcagaaggctgaggtgggaggatctcttaagacccggaagttgaggctgcagtaagccacaatccacagtcccacgctgcactccagcctgggtgacagagcaggactctacctaaaaatatatatatatataagtaaagaaaatcctaaggaatccacgcacatacaaaaatattacaactaataaatgatttcagcgaggtttgaggacacaagatcaataaacaaaaagctacaataatcaagagtgtggtactaacataaaaatagacatataggccaggtgcgatggctcacgcttgtaatcccagcactttgggaggccgaggtgggcagatcacctgaggtcaggagtttgagaccagtctggccaacatggcgaaaatccgtctctactaaaaatataaaaattagccgggagtggtggcgggtgcctgtgatcccagctacgcaggaggctgaggcaggagaatcgcttgaacctgggaggcggaggttgcagtgagtggagattgtgccattgcgctccagcctgggcaacagagcaagactctgtctcaaaaaaaaaaaaaaaaaaagaaagaaagaaacaaaagtgttttcaacaaatggtgctgggacaaccgaatattcatatgcaaaagaatgaacttggacccttccttataccatctacaaacattccaaatgcatcacaggtgtacttgtaagagacaaaattagaaaacacttagaataaatcataggagtaaaccttcatgacctccagtgaggcaatcattacttagacatgagaccgaaagcacaagggacaaaagaaaaaaatagataaattggactggacaaaatgtaaaagtcttatgctgcagataatatcattaagaaagtgaggtgtggggcgcggtggctcacgcctgtaatcccagcactttgggaggccgaggcgggcggatcacttgaggtcaggagtttgagacagcctggccaacatggtgaaacaccatctctactaaaatacaaaaattagccaggcatggtggcacacacctataatcccagctacttgggaggctgaagcacgagaattgcttgaacccgggaggtggaggttgcagtgagccgagatcatgccactcactccagcctgggtggtagagtgagactccatctcaaaataaataaatacataaataaaaataaaaaaacacagaaagggaaaaaatatttgcaactcatacatatgataaagtgtttgtatccagcatcgagaccatcctggctaacacggtgaaaccccgtctctactaaaaatgcaaaaaattagccgggcgaggtggcaggcgcctgtagtcccagctactcgggaggctaaggcaggagaatggcaggaaccccggggggtgtagcctgcagtgagccgagatcgcgccactgcactccagcctgggcgacagcgagactccgtctcaaaaaaaaaaaaaagtatttgtatccagaatatataccaatatgagttgatgtattgatatataccaatattgaccaatatgtatctagaatatatatcagttagttttttaaaagttggcttcagaattgtttataacaatgttgaatactaaatgattatgttaatgcctttataatatttaatattttatataaataaaataaaatgtagtgtcattctagaattctgtacccaggaaaatcattgttcacatacaaaggcaggcaggccacaaacattttccaaatatgtaagcatggagagaaggttgttctcatgatactttctctaaaagttttcaaagagtagcattttccaatagaactttctgcaatgatggaaatatctgtatcttcaccctccattatggtgaaatcttcaaccccacgtagttagctattaagcatctaaaatgtcactagtgcaactggagaactgaattttattaattttatcaacttgttaattgattaataagttaaattaattttattaagtttatttttattttactttatttgagacagggtctcgttctgtcacccacgctggagtgccatggcctcaacttcccaggctcaagcaagccttccacttcagcctccctagtagctgggacttacaggtgtgtgcctggctaatttttgtattttttgtagagacaaagtttcatcatgttgcccacagtggtctcgaactcctgggctcaagccatccgcccacccccaccttccaaagtgttgcgattacaggcgtcagccatcgccttatttattttattttatttttttttttttgagagggagtctcgctctgtcgcccaggctggagtgcagtggcatgatcttggctcattgcaagctccgcctcccgggttcacgccattctcctgcctcagcctcccgagtagctgggactacaggtgcccgccaacacgcccggctaattttttgtgtttttttcagtagagatggggtttcaccttgttagccagatggtcttgatctcctgacctcgtgatccgcccgcctgggccttccaaagtgctgggattacaggcgtgagccagcgcgtccagccaatcgccttatttttaagtttaaatagctatgcatggatatcttttttatagtgtagagtatttcacactgaagagaaggtaaaatagttccttccttccttccttccttccttcctttctttcttctttatctctttctttctttctctttctttctttctttttaaatttgagacagggttttgttctgtcacccaggccggagtgtagtggcacagtcctagctcacttcgtctccaactcctagtctcaggcgatcctcctgcatcagcttcccagatagctaggactacaggtacacccaaccacatccagctaattttttttttttcccagacggagtcttgctctctcacccaggctggagtgtaatggcgtgatcacggctcactgcaacctccgccttccaggttcaagtgattctcccgcctcagcctcctgagtcgctgagattacaggcgcctgccaccacgcccagctaattttttgtattttcagtagagactgggtttcaccatgttggccaggctggtctcgaactcctgaattcatgattcgcccgccttagcctcccaaagttctgggattacaggcgtgagccattgcgcctggtctaatttttaaaatatgttttagatttgggggattgggagggtctctctatgtttcctgggctggtctccaactcctggcctcaagcaatccccctgcttaggcctcataaaatgcttggattgaaggcatgagccactgtgcccagcccaaaacagcactttttttttttttgagacggagtctcgctctgtcgcccaggtgggagtgcagtggtgcaatctcggctcactgcaatctctgactcctggattcaagtgattctcccacctcagtctcctgagtagctgggaaaataggcgtacgccaccacgcccagctaatttttgtatttttggtagagatgtgatttcaaccatgttggccaggttggtcttgaactcctgacctcaagtgatctggccaccttggcctcccaaagtgctaggattacaggcatgagccaccacaccagcttacccagcattctctacagtcacaccccctatgggggagatgaaagggaaaaaagacaaaaaaaaaattataggagtccgggtgcagtggctcacacctgtaatcccagcactctgagaggccgaggcaggtagatcacttgaggtcaggggttggagatcagcctggccaacctggtgaaaccctgtatctactaaaaatacaaaaattagctgggcatggcggtatgtgcctgtaattccagctagtcgggaggctgaggcaggagaatcgcttgaacccaggaggcggaggttgcagtgagctgaggtcacaccactgcactccagcctgggccacagagactcaaaaaaaaattatagggaaaaaaagaaaaaattctaccagcattaaaataattataaaatgtatatttttgagacagggtcttactctgttgcccaggttacaatgctatgatgtgatgatcatggctcactgcagcctaaacctccccaggctcaggtgattctcacctcagcctcctgggtagcttagcctcccgggcagcctcccaggtagctgggactacaggcatgcatcaccatgcctggctaatttttgtatgtttgtagagacagggttttgccatgttgctcaggccagtcttgaactcctgagctcaagtgattcacccacctcaacctcccaaagtgctggaattacaggcatgatccaccatgcctggcctccatacatccatattaaccttgaacgtaaatagtccgaatgccccacttaaaaggcacagggtgtcaagttggattaaaaaaaacactacctatccatctactgtcttcaagagacccatctcacatgtagtgacacccatatgctcagagtaaagcattggagagagatctagccacaaacagaacacaagaaagagcagggtcactattcttaatcagataaagcagactttaaaccaacaacaataaaaatggacaaagaaaggcattatgcagtgataaagaattcaattcaataagaagacaaatatcctaaatatatttatacccaatattggatcacccagatttatgagtccttctagacctatgaaaagactttgaaagccacacaataatagtagggtacttcaacacctgactgacactgctagaccgatcattgaggcagaaaactgacaaaaataggctgggcacagtggctcatgcctgtaatcccagcactttgggaggctgaggtgggcagatcacttgaggccaggagttcgagaccagtctggccaacatggtgaaaccctatctctgttttgtaaaatacaaaaattaggtgggcatggtggtgcacgcctgtgttcccagctactcaggaggctgaggcaggagaatcgcttgagctgggaggtagaggttgcagtgagctaagattgcgctactgcactccagcctggatgaaagagcgagactctgtctcagacaaaagaaaaagaaaaaggaaggaaggaaagaaaagaaagaggaaggaaggaaggaagggagaaagaagaaagaaagctgacaaaaattctggacttaaattcaacacttgaccaattggacctaatagacatctacagaatactccacccatcaaccacaggaatatacatttttctcatctgcacatagaacacattccaccacatgcctggccataaagcaagtttcgataaatttaaaaaaacctaaatcatagcaaccatattctcagacctcggtagaataaaaatggaaatcaataccaagaagatctctttaaaccacacagttacatggaaattaaacaacttgctcctaaaagacttttgggtaaatagtgcaattaaggcagaagtaaaaaaatctttgaaataaatgaaaacagagacataacatacggaaatctctgggatacagcaaaagcagtgttaagagaaaagtttatggtgctaaacacctacctcaaaaagttagaaagatctcaaattaatgaggtaacatcccacctagaggaactgcaattattggggaacctgccctgatagtcacgtaagttcttttctattttccctaaacatccgctggtttgagaaataaagggacagagtacaaagagagaaattttaaagccgggcatctgggggagacatcacatgtcggtaggttccacgatgccccacaagctgcaaaaccagcaagtttttattagggagtttcaaaaggggagggagtgtgcgaataggtgtgggtcacagatcacgtctttcatgaggtaatagaatatcacaaggcaaatggaggcagggcgagatcacatgaccacaggactggggtgaaattaaaattgctaatgaagtttcgggcaccattgtcattgataacatcttatcaggagacagggttttgagatcaaccggtctgaccaaatttattaggggggaatttcctcttcctaataagcctgggagtgctatgggagactggggtttatttcatccctacagtctcgaccacagaagatggccacacccaagggggccatttatagacccaccctcaggggtgcattctctttctcagggatgttccttgctgagaaaaagaattcagcaatatttctcccatttgcttttgaaagaagagaaatatggctcttttccgcccgtctcaccggtggtcagagtttaaggttatcgctgttattccctgaacaattgctgttatcctgttcttttttcaaggtgcccagatttcatattgttcaaacacacatgttctacaatttgtgcagttaacgcaattatcacagggtcctgaggcgacatacatcctccttggtttacgagctgacaggattaacagattaaagtaaagacaggcataggaaatcataagggtattgattggggaagtgataagtgtccatgaaatcttcagagattgcagtaaagacaggcataagaaattataaaagtattaatttgggaaactaataaatgtccatgaaatcttcacaatccacgttcttctgccatggcttcagcgggtccctccgtttggggtccctgacttcccgcaacacaatggccccaaagctagcaggagaaaagaaataattaaaatcagagcagaactgaatgaaattgggacacaaacatccatacaaaaaatcaatgaaaccaaaagttggttttctgagaggataaacaagatcgataggccactagctagattaacaaagaaaaaaagaggctgggtgtggtggctcatgcctgtaaccccagcactttgggaggccgaggcaagtggatcacttgaggtcaggggttcgagaccagcctggccaacatggtgaaaccccgtctctactaaaaatacaaaaattagctgggtgtggtggcgcacgcctgtaatcccagccacttgggaggctgaggcaggagaatcacttgaacctgggaggtggaggttgtggtgagccaagattgcaccactgctcttcagcgtgggcagcagagtgagactgtatctaaaataaataaataaataaataataaaaataataataataaaaaaatttaaaaaacgaagaaaaaaaagacagaatatccaaataagcacaatcagaaatgacattacaacaagtccacagtgatttaaaaaagatcctcaagatgaacacctctatggacacaaacttgaaaatctgaaggaaatggataaattcctggaaacacacaatctgccaattttgaagcaggaagaaattgaaaccctgaacagaccaatatcaagttatgattctgaatcattaaaaggagtctaccaaccaagaaaagcccctgatcagatggattcacagctgaattctactacatgtacaaagactaagactaatcctcctgtattagtccgttctcacactgctataaaggcatacccaagactgggtaatttataaagaaaagaggtttaattgactcacagttctgcaaggctggggaagccttaggaaacttatagcagaaggagaagcagacacatcttacatggtggcaggagagagagaatgaatgcaagcataggagaaactgccacttttaaaaccagaaatcagatcaggctgggcacagtggttcatgcctatcatcccagcactttgggaggctgaggtgggtggatcacctgaggtcagaagttcaagaccagcctggccaacatggtgaaaccctgtctctacaaaagtacaaaaattagccagacgtggtgatgcatgcctgtgatcccagctacttgagaggctgaagcgggagaattgcttgaacctgggaggcacaggttgcagtgagctgagatcatgccattgcactccaccctgggcaacagaacaagactccatctcaaaaagaaataaaaataaataaataaataaataaaaccatcagatctcatgagactcattattgggagaacagcatggggggaactgcccccataatccaatcacttccctcccttgacacatggggattaaaattcaaaatgagatttgggtggggacacagagccaaaccacatcacctactaaaactattcccaaaaaattgaggagagacccctccctaactcattctaggaagccagtatcaccctgatcccaaaacctggcaaaaacaatgaaaaaataaaactgctgggtatggtggctcacgcttgtaatccctgcactttgggagaactgagggaggtggatccttgaggtcaggagttcgagaccagcctggccaacatggtgaaacctcatctctactaaaaatacaaaaattagccgggtgtggtggtgcatgcctatagttccagctacttgggaggctgaggcaggagaatcgctcgcacttgggaggtggaggttgcagtgagcccagatcgcagcactgcactccagcctgggagacagagtgagactgtctaaaaaaaaaaaaaaaaaaaaaaaaaaaaaaaaagaaagaaagaaaagaaaactacaggccaatatccctgatgaaaatggatgcaataatcttcaacaaaatactagcaaactgaatccagcagcacatcaaaaagttaattcatgaggccgagataggtggatcacttgaggccagaaattcaagaccaccctggccaatatggtgaaacccatctttactaaaaatacaaaaattagctgggtgtgttggtatgtgcctgtaatcctaactattcaggaggctgaggcatgagaattgcttgaacatgggaggcggaggttgcagtgagccgagatcatgccattgcactccagactgggtgacagagtgagactctatctcaaaaaaaaaaaaaaaaaaaaaaacagatgcagtggctcatgcctgtagtcccagcactttcggaggctgaggtgggcagattacctgaggtcctaagtttgagaccagcctggccaatataatgaaaccctgtctctactaaaaatacagaaattagccaggcattgtggcccacacctgtagtcccagctactcaggaggctgaggcaggagaatcacttgaacccaagaggtggagggtgcagtgagccaagatcgcaccactgcactccagcctgggtgacagagtgagagcccatgtcaaaaaaaaaaaaaaaaaggccgggcgcggtggctcaagcctgtaatcccagcactttgggaggccgaggcaggcgatcacaaggtcaggagatcaagaccatcctggctaatgtggtgaaaccccatctctactaaaaatacaaaaaaaaaaaaaattagccgggtgtggtggagggcgcctgtagtcccagctactcgggagactgaggcaggagaatggcatgaacttgggaggtggagcttgcagtgagccgagattgcaccactgcactccagcctgggctacagagcgagactccatctgaaaaaaaaaagaaagaaagaaaaaagaaatcttagatgacaccagcaaatggaaaaacattcgatgctcatgtattggaaaaatcattatcgttaaaatggtatactgccaaaagcaatctacagattcaacattatttatttatctatttattttttggagacagagtcctctgtcacccaggctggagtgcaatggtgcaatttaggctcactgcaacctccgcctctcaggttcaagccattctcctgcctcagcctcctgagtagctgggattacagatgcctgccaccacacctgattcatttttgtattttagtagagacagggctttaccattttgcccaggctgatctcgaactcctgagctcaggtgatccgccccccttggcctcccagagtgctagtattagaggtgtgagccaccacacccagcctaaacattattcctatcaaggtactgtgtccagagttggttccttctggtgggtttgtggtctcggtgacttcaagaatgaagccgtggaccttcaccgtgtgacagctcttaaaggtggcacagacccaaagagtgagcagcagcaagatttattttgaacagtgaaagaacaaagcttccacatcgtggcaggggacccgagcgggttgccactgctggctgtggatggccagcttttattcccttattggccctcccatgttccatttctgtcctatcaaagtgcctttcttttttttttgagacggagtctcactctgtcccccaggctggagggcagtggcacgatcttggctcactgcaagctccgcctcccggattcacgccattctcctgcctcagcctcccgagtagctgggactacaggcacctgccaccacgcccggctaattttttgtatttttagtagagatggggtttcaccatgttagccaggatagtctcaatctcctgaccttgtgatccgcctgcctcagcctcccaaagtgctgggattacaggcgtgagccaccacgcctggcctcatgtacaggcttttgtgcagacctgagtttttagttcatttggataaatatcaaggagctcgactgctggattgtgtggtaagagcatgtttagttttctaaggaactgccaactctcttccaaactggctgtataccattttgcattcccaccaacaatgaatggcccttcctattgcttttcattctcaccagcatttggtgtgtaatttctgaataaaatcctttgtgttttccaagtatacagttattttgatctgaaaataataatttttcctccattctgatttctctgtctctatattctacctcttgtcaaattatattggctaacacatccagaaaaatattaagtaatagctgtaaaaatggataaactgcttttgttcttgacttcaagtttgggagcacttttatggtgcccccattaagtatgatgctgaataattttttgtatttttagtagagatggggtttcaccatgttagccaggatggtcttgatctcctgaccttctgatccgcccacttcggcctcccaaagtgctaagattatacagtgagccaccgcccagcccagagtgcacttttttcaatcctccctgcaattggctacttttaggatcctgctgattggtgcattttacagaacactgattggtgcattttacagcatgctgattggtgtgttttacagagtgctgattggtgcattttacaatcctcttgctagctacagcgtgctgattggtgcgttttacagagcgctgattggtgcattttacaatctgcttgctagctacagagcgctgattggtgcgttttacagagcactgattggtgcattttacaattctcttgctagctacaaagcattgattggcgcatttttacagagtgccgattggtgcattttacaatcctctttaaagacagaaaagttctccaagtccccactcaacccaggaagtccagctggcttcacctgtcactaccaacgtcatttttcaaggaactagaaaaaattattctaaaatctacatggaatcagaaagactctgaatagcgaaagcaatcctaagtggaaagaataaagccagaggcatcacattactggacttcaagctatactacaaggctacagtaaccaaaacagcatggtattggttaaaaaaaaaacaacacctatggtcatctgatctttggcaaggttgataataacaagcaaaggggaaagaacactgtattcaataaattgtgctaagatagttggctagctatatgcaaaagaataaaactggagccccacttttcaccgtatattaaaattaactcaaaacaaattgagaatttaaatgtaacccttcaagctataagaatcgtagaagaaatcctgggaaacaccattctggacattggctttgggaaataatttatgactaaatcctcaaaagcaattgcaacaaaaccaaaacttgacaaatgggacctaattaaagcaaagaacttctgcacagcaaaagaacctatcaacagagtaaacagacaacttacaatgggagaaaatattcataatttatgcatccaacaaaggttcaatatcagaatctataaggaacttaactgaacaaacaagaaacaaatatccccattaaaaatgggcaaatggctgggagaggcggctcacacctgtaatcccagaacttttggagcccaaggagggcagattacgaggttgggagttcaagaccagcctgtccaacatggtgaaaccccaactctattaaaaatacaaaaagtagccaggcgtggtggtgtgcgcctgtaatcccagctacttgggaggcttaggcaggagaattgcttgaacccaggacatagagggtgcagtgagccaagattgtgccattgcactccagcctgggcaatacagtaagactccatgtaaataaataaatatataaataaataaataaaataaaatgggcaaaacacataaataggaacttctcaaaagaagacatacaagtggcccacaaacatataaaaaaatgctcaacatcactaatcatcagagaaaagcaaatgaaaatcacaattagataccatctcacaccagtcggaatagctattattaaaaagccaaaaaataacatgctgttgaggctgcagagaaatgggaacacttatactctgttggtgaaaatgtaaattagttcagttactgtggaaagcagtttggagatttcttttcttttttttttcttcaagacagagtcttgctctgtcacgcatgctggagtgcagtggtacgatctcggctcactgcaacttctgcctcccagggtcaggcaattctcctgcctcagcctccagagtagctgggattacggtcacccaccaccacacccagctaatttttgtgtttttagtagagacagggtttcaccatgttggccaggctggtctcaaactcctgacctaaggtgatctgctccactcggcctcccaaagtgctgggattacaggcgtgatccactgtgcccggcctggagatttcttaaataacttaaaacagaactaccatttgatccagcaatcccattactgggtatacatccaaaagaaaataaattatcctaccaaaaaaacacatgcatttgtatgttcattgcagcactgttcacaatagcaatgacatggagtcaacctcggtgcccatcgatggtggactggataaagaaaatgtacaaacacgctatggaatacttcacagccataaaaagtatgaagtcatgtcttttgctgaaatatgaatgtagcttgaggctgttatcctaagtgaaataatgcaggaacaaaaatccaaatgctacatgctctcagttataagtagaagctaaataatgagtattcgtggatataaggatggtaacaacaggccagatgcagtggctcacgcctgtaatcccagcactttggaaggctgagatgggtggatcacgaggtcaggggtttgagaccagcctggccaacatggtgaaactctatctcttctaaaaatacaaaaattagctgggtgtggtggcggtcacctgtaataccagctacttgggaggctgaggcagaatcacttgaacctgggaggcagaggttgcagtgagccgagattgcgccattgtactccagcctgggcaacaagggcgaagcttggcctcaaaaaaaaaaaacaaacaacaacaacaaaaaaaaacaaaacctgaaaatctaatatttaaaattaagaactcaatgtatagatttaacagcagattggagattatagaagatagactcaataacctgaaaaacagaaaaccttcaaactgaataattgaaaaaaaaattgacatcacaaagtgtaaaagacacggtgaacaagatcaaataatcttacatatgggctgggtgccgtggctcatgcctgtaatcccagcactttgggaggctgaggcaggtggatcaccggaggtcaggagttgaagaccggcctgaccaacatggtgaaaccctatctctactaaaaatacaaaaattagccgggcgtggtggtgggcgcttgtaattctggctactcgataataatactattataatagtattatctacctcagtagataatactgctgaggcaggattatcgcttgaacccgggaggcagaggcagaggttgcagtgagacgagattgcgccactgcactccagcttgagcaaaaagagtgaaactctgtctcaataataataataataatcttacatatgtaattggtgtctcggagaacaggcatagagaatgcagcaaaaaccatatctgaagagataatgattgagaatttctcaaaactgatgcaagacatctacccacaaatcagagaaactcaatgatatccaagacagataaatacaaagaaaacaaagatagggcacaaaataaatggctaaaaatcactaacaggctgggtgcggtggctcacgcctgtaatcccagcactttggggggctgaggcgggcagatcacgaggtcaggagatcgagattatcctggctaacttggtgaaacccggtctctactaaagaaatacaaaaaaaattagccaagcgtggtggtggacgcctgtagtcccagctactcaggaggctgaggcaggagaatggcgtgaacccgggaggcagagcttgcagtgagccgagatggcgccactgcactgcagcctgggcgacagagcgacactcctctaaaaaaaaaaaaaaaatcactgacaaagagaaactgttaaaaagaagtgagagggcctggtgtggtggttcacgcctgtaattcgagcactgtgggaggcccaggtgggaggatcacttgagctcaggggttcaagaccagcctgggcaacatagggagatgtcatcgctacaaaaataatgatagtaatagtaataaaaaattagccgggcgtggtgcaggagcctgtggtcgcaggtaccctggaagatgaggtgggaggatcgcttgagcccaggaggcagaggttacagcgagcctagggtgtgccacggcactccggcttgggcgagacagcaagaccctgtttggaaaaaaaaaaaaaagaaaagaaaaaagaaaaaaaaatcaacagtaattgcagccattgcttagaactaagactaaacaaagcttttgtttggaaaggagtactttttcattaacattgtttagaattttctgacacatgatgataattaaaagcaaaccatcctgcagttggcttcggtattgtttttatcttctccaccatcaatgcatatccttactgcctacacaggctctcagcaacgcactgttggttttccattgcagtcacctccactttattcttccagatcgagtatgttcaaaactgaactcatcttccgccataaatctgctattattatgtttttgcctgtcaggacatcggcttataattttggaaagcattcacagttggggcgggtaagacatagataaagaggccaatcacaataccaggggtaagatcaataggaaaaccagagagcggacgcctgggccaggcctcacaacgtccagagctggaatgggtcttttgctttcggcgcaggggtgacgggatcagcggagggtaggggtgtacactagctgcggtctgatttagcccttttaggttaaaagctggagaaggggctgaagtctcaaacgcgcttagcagctcctgaacgcggttcccatcccagcgcgttctgagggaggccggggctaaggacgcggtgacgggcgggggcggggcggccccgggtcgggaggcggggcgggagcgccggaagcgggcggtgccaggcccagcctcgcaggcggaagggcgcggaggaggtgacgcgataggccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcaggtaagcggggacgcgggcagacgagtgacggactcagcgatcgcctggcggggctggctggggccattcccgcgccggtgcgccacctcagcgcccggtccggaggcctcgagccgccctcccccgcccgagctggaggccgccgtccgtctcggccacagcctccctttccgggggaggcgagcgagctcgtcccgaggggccgctgccctgcgctctcgctccagccgggctgtgcgtcgcaggcaccgggaagctggcgccccccagctcctcctgaagccgggaaagctctgagaggaggagccgctgtcacaggcctccagctccggccgccgtggaagtccggggtttttatttgcttagaccgctctgcctccttccggccttcgtttctttcctcgcgctccccgggacccttttccagagagcccggttgggcatgagcgcggtgggagacgtcttttcccttcggtctgctctgagcggtatcagcctccgctctacgccctgtggccactctgtcggggtggagggatgcggagaggatgtgggagttttggacttagagcgagaatagccgaggtgaaatcctaccctgctctctggtagtgtttttcatctcatgctagatagacatttcgacctttttcaccgcaggtaaagtgggactttcttctaccaatgtaaattataatgtttggagaattaaatgaagaaagcagacgttagttatgaaatgttttgagaatctggttaaatttaatttaagaatatccaggacacttcatgataggttcctacttatgttttttttttgcattttgcccggaataactaagcttggtatggaaaaggttgcctagagatgccaggcgctcgtgtggtcagagcctaactgcagtctctgttttgggtgggcagcatcaggaagaaaccagactctctcctagccatccacatgtctcacgcttattgatggcatattattggtatatgagggatggcttatatcagttttgatctttactcaagatagctttttcccagtgcatcttttctaggagaaaagcttggtatgtagaggagggtgctggggaggggggcttcatttacacctgggctcacaatttttttttggaggggggacagggtctcactctgacacccagcctggagtgcagtggcgcgatcttttcagctcactgcaacctcctcctcccaggttcaagcgattctcctgcctcagcctccagagtagctgggattacaggtgcccgccatcgcgcccggctaatttttgtatttttagtagacatggggtttcaccatgttggccaggctggtctcgacctcctgacctcaagtgatctacctgcttccgcctctcaaaagtgctgggatcagccgggcgcggtggttgacgcctgtaatcccagcactttgggaggccgaggcgggcagatcacctgaggtcgggagttcgagatcagcctaaccaacatggtgaaaccccatctctactaaaaatacaaaattagccaggcgtggtggcgcatgcctgtaatcccagctactcggaaggctgaggcaggagactagcttgaacccgggaggcgaggttgtggtgagctgagatagtgccattacactccagcctgggcaacaagagcaaaactccgtctcaaaaaaaaaaaaaaaaaaaaaaaaaggtgctgggattacaggagtgagtcactgcgcctgggctatattactttctaaatcagcctttttttttttttttggtaggccattatgtgaatccttcaaaaatcatagaaaaattgaaatttaacaatattttgcttttattctagcttgtcataaacccagtgctctatacacaggcctgcctttctgcctccttcatcctggcatgcatggccatttactttgtgttattagccagcttcctatggagctcagtttgagaacggggttctgtgcttctctagttgccaaacatctgattgaagtagatcaccttggcatttgcgatattaagcatgtctttgcgaatttttagttcctttttcttttcttggttagattgtactctgtcactgatttaaagaatttggtagacgctcagaaagggtcaactggtaaggtggtcacagtgctttacatgtatttttcttacctattatggtgaaacccttgtgactttttttgggcgtgggtaatattttcaaaattaaggtaaataggccatcaggctgcgttgaactttctcttttagggaaatatattcattctccaattattctttggtagccttcttattgctttagcaattcctactctattattagtagagccggaaatggaccctacatcacagattctccaaatatactaaattattttttctctaaaatgatcatgtttatagcatgttgattttctttttttttcttttgagacagagtttcactcttgtgcaggctggagggcaacagcttgatctctgctcactgcaacttccgcctcccgggttcaagtgattgtcctgtctcagcctcccaagtagctgggattacaagcgcccaccaccacgcccggctaatttttgtatttttagtagagatggggtttcaccatgttggccaggctggtcttgaactcctgacctcaagtgatctctccgtctcagcctcccaaagcgcggggattacaggtgtgagccactgtatccggtcagcagcatgttgattttctacaaccagatgacaaaggatatcctaaagtcagtgatttaaaaagtcatgttggcttggtgcggtggctcatgcctgtaatcccagcactttgggaggccgaggcgggtggatcacgagtcaggagttagagaacagcctggccaacatggtgaaactccgtctgtactgaaaatacaaaaaaattagctgggcatggtggcgggcgcctataatcccagctactcgggaggctgaggcaggagaatcgtttgaacccatgaggtagaggttgcagtgagccgaggttgcaccattgcattccagctttggcaacagggtgagactctgtctcagaaaaaaaaacaaaaaacaagtgatggtaacacataggttgtctaatacattcagagtctagagagacctggtatgtatctgagaaaccaaatagctgaatctctaaaattttatttttgtgtctggaataccttaattctgaagttttagttgttgttgaatttcacattctgacaggagacaagtagaggtacatgtgaagggttagtatgaacccagggttacagtttcaatctaaactgatactgcagagttaacattgaaacaaagcagctctagggagctggcaaaaattgaaggttagaagtcacttgctggctcttgaggcagtcttctgactctgaaactacttgagactaaaattttcaagaattttttaacttaattttgtaaagatataatttacggcctggtgcagtggctcatgcctgtaatcccagcacttagggaggccgaggtgggttgatcacctgaggtcaggagtttgagaccagccaacataatgagaccccatctctactaaaaatacaaaaattagctgggcatggtggcacacactcgtactcctagctactcaggaggctgaggcaggagaatctcttgaacctgggaggtggaggttgcagtgagtcgagatcaggtcactgcactccagcctgggtgacacagtgagactccatctccaaaaaaaaaaaaaaaaatacagtcaaatacatagaccttaagggtttttattttttaaagcatatgtacacaaaatggaagacagaaaaatagcaaaacattttggaagctggaatgcagattgatttaagcagtctgcccgccttggcctcccaaagtgctgggattacaggcgtgagccaccacacttggccgatataactttttcgtagtgaagcttcagttaacctgtacggtggctgcgctgtgaactttcacccaaatattgggctccttaaggggctgtttaggcttggggctgtcctagggtcggtgagtatctagtaagagtgtaaaccttctatttcccttgtgtgcgtgttttatctttgaaggaatgttgatatttggtcagtatgaacatacagcagcatggctgggaatacaggggcagaaatgtaaaggaaacgcatgtgaagtttgcttttaattactggaccgttgtattcaagaaccttcaatggcagtatcttgtctttgctccagggtcagattccctaaagaagaagggatctcctacttggagagtacaaattgggcttccagcagtctggcttctatacttagggaaaggctggaggtcttagtattcgttatgtaaacactcattcttgttcatttaactcaactattttcagtaagatgacctcattctcaactggaccagttgaaaagctttccagtccaggaattctttgtttttacataggattgttttaagctgctacgtgtggttagtggctaccatattggatagcggagctgcactatccagtgtggtagccactagccacatgtagcagcctaaatctaaataattaaaattaaaggtttagttcctcacttgcactagacatgtttcaagtgctcaatggccacatttgcccagaggctaccgtattgggcagagcagatatagaatatttctgtcattgcagaaattttattgggctgtgctgttctagtctagagaagaagactccaggtgtctgcaaggatgggtaggggacagttggctggttttgtggcatgtgggaggatatttaaatcatttgaccaatccttttatttttagcgtcatattcatattcacatccctctgtagaacaattcctgacctgttttgaggtattgttctttagattgctttcctccctgcaagcttgagatttaactttttttttttttttttttttggagacggagtctcgctctgttgcccaggctggagtgcagtggcgtgaacttggctcactgcaacctccacctcccaggttcaagcaattgtcctgcctcagcctcccaagtagctgagattacaggcacatgccaccatgcccggctaatgtttgtattttagtagagacggggtttctccatgttggtcaggctggtcttgaactcctgacctcaggtgattcgcctgcctcggcctcccaaagtgctgggattacaggcgtgagccaccgcgcccggccccagccgagacttaacgtctttagatctttaagtcaatccacattccaactttcaaaatgtttttgctgttgttcggtgttccattttgtgtacatatgctttaaaaaaacaaaagcccttcaggtttatgtatttcactgtaggtaaattatatctttaaaaaattaagttaaaaaattcttggcagccgggcgtggtggctcacgcctgtaatcccagcactttgggagtctgaggcgggtggattgcgaggtcaggagatcaagaccatcctggctaacacggtgaaaccccatctctactaaaaatacaaaaaattagccgggtgtggtggcgggcgcctgaagtcccagctactcgggaggctgaggcaggagaatccttgaacctgggaggcggagcttgcagtgagctgagatgtgccactgcactatagcctgggtgacatagtgagactccatctcaaaaaacaaaacaaaacaaaaaacataatttaattttaattagttatttaggaatgggtcttgctgtgttgcccaggttggtctcaaattcttgacctcaaaggatccttctgcctcagcctcttgagtagctgggattatagacatgcaccatggtgcctggctggttttttcttttaaaaaattaatttattggctcacacctgtaatcttaggtactcagaaggctaagtcaggaggattacttgattgagcctgggagtttggggcttcagtgagccatggctgacagaatgagaccttttttttttaaaaaaaaaaaaagataaaggacaatttttttattcttaatgaagttttaagagggaatgatggtaaaatgtgtctgcttaatctgcagtctttatccagaagtaaagtgcttcatcagaatttaaacatgtataagaatctccactaaaaaaatgtttgagctttacccaggcttcttgaacaatttttatatatcgccttttttgttccaccttggtttttgtcctttccattgtactaaaatttctcctgcaaatgtcaagagaattcagtgaacacttttaatccttatcttgctcgacttctcaacaacctttaactgaccatttccctctttttagaaacctgttctagctttgctgataccacctttacctgatttttgaccttatctccctggtcattttttttcactttcctttgcttagtctttctttatttcttaaatcctggagttccagctgggcacacctgtaatcccagcactttgggaggctgagttgggtggatcacctgaggtcagaggtcgagaccagcctgaccaacatggagaaacccggtctctactaaaaatacaaaattggctgggcgtggtggcgcatgcctgtaatcccagccacttgggagcctgaggcaggagaattgcttgaacccgggaggcggaggttgcagtgagctgagatcgtgccattgtactccagcctgggcaacaagagtgggaaaaaaaaaaaaattcctagagttccttgggctattgccctagggtacattctctcattctcttctaccttttacaaattctttctaggtgatcttatcattttctatagctttggttactctaagctgaaaactggaattcacatgatgtcctcttttcagaattcttgaactgtatatctagctgtatatatccacttggacttctaatggtcatctcaaattgaacatgtgaaagactaaaggcatagtcagtataaccttcccctaatcgatctccgtctgtgtttcgtatcagtgataccactatctacctagtagctgatactggaacatttacccccaacagataggcttttgacaaatgacaagtcctgtcatttctgtgtcctgaagattgattcactttgctacatcctcccagtttttctcttaatccaagaagctgtcccactgtatctgcattgatttacctgtaacagattcctaatgggtttcttctgctgtggccttctccttgccattctgcacattgcaggtagaatgatttttttcaagaatatgaatcagatctttgtctttcagtggcttcacaccaaccttatgttaagtgtcagcatcgtgaatttagctcttctgttcctcatctaccccttccgtgcctctaagtgttactgaagttctttccattccttgaaatactgaattccctctctttcctaggaactcttgctcatcatttgtctcagctgaaaaataatttcttcagagaaaaaataatttcttcagagaggtgtttcctgacccttttgccagatatttccattgtaccctgaatttgactttttttaatttttattttatttttttatttttttgagacagggtcttgctctgtcacccaaactagagtacagtggtgtgatcatagctcagtgaaactttgacctcccatgcccaagcgatccttccacctcaccctcctgagtagatgggaacacaggcatgtaccaccacttttggctattttttttggagacaggatctccctgtgttgcccaggcaggtgatcttgaaatcctgggctcaagcgatactccacctctgcctcccaaagtgctgggattacaggcataagccaccatgcctggccaatattggcagtataccatagtaagcgtttatttgaattacatgtttatttcatattaagaagtttgtttatatagaagtgatttttccactgataaagtaaaatatgatattctaaactagaggttcccaaactttctctgtttacaccctccttaatatattttttacatgtccctaagcttaacagtttgatttattaaataattaggttcagacagcttaagaagtatttatgggccaggcgctgtggctcacgcctgtaattccagcaggcggatcatgaggtcaagagatcgagactatccttgctaacacagtgaaaccccttctctactaaaaatacaaaaaaaattagccgggcctggtggcgggcgtctatagtcccagctaggctgaggcaggagaatggcgtgaacccgggaggcggagcttgcagtgagccgagattgcgccactgcactccagcctgggcgacagagcgagattctgtctcaaaaaaaaaaaaaaaaagaaaagaaaaaagtatttatgttctttcaacctaattgacatctaagaaatacacaaattggaagacaaagtcagatagatgtgatggctcgtgtctataatctcagctctttcggtgggcggatcacttgagtccaggagtttaagaccagtctgggcaacatagaccgtatttctacaaaaaaaaaaaaaaaaattgccaggcgtggtggtgtgtgtctgctgtagtcccagctactcaggaggctgagggaggattgctggagcctggaaagttggggcgagctctgattgcaccagtgcactccagcctgggtgacagagtgagacactctcaaaaaaataagaaagagaaagacaaaattacattttgatttcattcttaaataaccacagttatttaccgtatatacttgttgggcactacaaaacccaaaccgtggaatcatattggactctgccacccacattgcttactttttaattaaaacaaatttgcttttggctgggcatggaggctcatgcctataatcccagcactttgggaggttgaggtgggaagatcgtttgaggccaggagttcaagaccagtctgggcaacatagtgagaccccatcttactaccttattttattttttttaatttttaattttaaatatttatttagagatggagtctcactgtgtcacccaggctggagtgcagtggcatgatcttggctcactgcagcctccactccctggttgaagcgattcttctgcctcaggctcctgagaagctggccattactggtgcccaccaccacacacggctaagttttgtatttttagtaagagacagggtttcaccatgttggccaggctggtctggaactcctgacctcaggtgatctgccctgctcgaccttcaaaagtgctgtgcttacaggtgtgcgccaccgtgcccggccactatctcgctattttaaaaaataaataacatttgtttacatctttgttttctccactcattttttgctctaaattgatatttgcacagtatttttttttaaatcacagcaaccaatagatactcagctttgcaaagattatgatatcatcaaaaggaacatagtgtgatctattttgaagctgaactgtcttgaactagtagtttataaggtgtttgacaagtatagaagattactttttccctgtaatttagaatttcctgttgtgctctcgtgagttctctacagaatcccaggttgccttgggcacagtttgggaactgtgatcctaaacttttgatagtttggtgtatatgcttttagacatttttctccaaacattcaagcatatgcatatatttttccttttaacaaaagtgggctggtacatattggtcagcaacttcattttttccattcagcagtgtatcatggtaaaggtggtggattgaatatatacgtttaattttatgccagcctgaaaatttcattaaaacaatggaggacttaaaaaccctctagataacaaagaacaggaacaatgagaataacaacaatatcgtgaaagctggaaagcagaaaagactaatggcaactaattcgccaacttgagaaagctgtatcctaaaccaacagtggagagagccttcaaatagtcatgttatgttaccaaaccctttaaaagtctcaagattagctgtgtcctgtactgtggaggtggaggtgggacagaaaatatgaggagttgtttgaaagtctgtttcagaaaagtttccactcctgacctccctttcttctccccgtagacataaatagggtaactagagacttactatctggagtagaaaacgattattatctggactgagggataccatgcatagttaaggataaggtactgtgccttatagtggaaatctatatgctgaaggtagaaacctctagctttttttcctgacatagttctcagaatcttgcccctttctgctgtttcccattcaccaaaagcagcctctttcaagtctttgaggtattgttttggtataaacaacatgtctttaaattacctttttatttttatattttatgagatggagtcttcctgtcacccaggccagagtacggtggcatgatctccgctcactgcaatctccgtctctcgggttcaagtgactctcctgcctcagcctcccgagtagctgagattataggtgcccgccaccatgtctggctcatttttgtatttttagtagagacaaggtttcaccacgttggccaggctggtctcgaactcctgacctcaaatgatccgcttgcctcggcctcccaaagtgctggtagtacaggcatgagccaccatgcccggcctaaattacctttttataatgtaacttgtgattacttagtttatgctttatctgttgacttgaagatgaagattgttcttttttacatctgttccccacgtctgtgtacttgcatacttcttatcttccctccaagataccactgtatcttcccactatagggatgctataaggggcagtattaccattccaggtgagataattcttcattgttgtgtttattgcatgatacttagtatccttggaccccagcggtaaatgtcaataccaacctgaatgtattacagcaaccaagaatttcccacacatttccaaatgttaggttgaggtggtatggagtatctggttgagaagcactgggttagatcagtgtttagcttattactattatgtaaatggtagtcatagttaagccatgtagtataccaaggtttacaaccactgttttccctttcttgtacatttttctgttgtccctgaaattaattgtctttatcttttgtttagtgttctctgtacctactactaactgcaaactctcttctggttgtctgtttctcctttatttgctttcatacactttagaaattctatcaggatcacattcttggagccttttgactgacttttgaccgctcccttctggattggtggccctccaggcttaaggcacattgtcattctgcatctatttttactgttatctttagtattctttttgcctgactcttgtttttggatctcatttcctgcatcctgtgtattcttgacttactcccatatttgccagagtaccttctcctgtgactctctgagaaggatgcatgggaggtaaatattttgataacttacatctctgtaaaccttttttgttagttgttatgttagtttcagtctgtcattttgtggtactttctgggagattgctcaaaattttaaatgttttaatgttttacttttaacttcgaaataacttcaaatttaccgaaaaaaattgcaaaatattacagtttttctatatgcttcacctagctttgctccgaagttttgtttcagttttttttgtttgtttgaagacatggtctcactctgttgcccaggctggagtgcagtggcgtgatctcggctcactgcaacttctgcctcctgggttcaagtgattctcctgcctcagcctcccgagtagctgggattacaggttcatgccaccgtgcctggctaatttttgtatttttggtagagacagggtttctctatgttggccaggctggtcttgaactcctgaccttagttgatccacccacctcagcctcccaaagtgctgggatcacaggcatgagccactgtgcccaaccttacttcagtttttttaaggagacagagtcttgctatgttgcccaggctgatcttgaactcttgggctcaaacaatccttctgtctccgcctcccacgtaggtgggtctacaggtgtgcaccactgtacctggcctctccaatgttatagaactgcagcacattgtcaaggccaggcaattaacgttgagagaatactgctaactgatctgcacaccttattccaattttgtcagttgtcacatgacttttctttttctgaactgagactcaatccaggattataccttgtttaattgtcgtctccttaatctcagtctttcattctaggacagtctgtctttgtctttcaggactttgactgatgtgattgaagagtattagccagttattcttttttttttttttttttttgagacggagttttgcttttgtaccccaggctggagtgcaatggcgtgatttcggctcactgtcacctgcgcctcctgggttcaagcaattctcctgcctcagtctcccgagtagctggattacaggtatgtgccaccgtgcccggctaatgtttgtatttttagtagagacagggtttcaccgtgttggccagactggtctcgaactcgcgacctcaggtgatctgcccacctcggcctcccaaagtgttgggattacaggcatgagccaccgcgcctggcccttttccttttttattttttttttgagataggacatcactctgttgcccaggctagagtgccatggtgcaatctcagctcactgcaaccacaaactcctgggctcagttgatccacccacctcagccttctgagtagctgggaccacaggcacatgccaccacacttggctaatttttatatttctttgtagagatggggtttcatcatgttgcccagagtggtctcaaactcctgggctcaaacagtccacccatctcagcctcccaaagtgtgagattgtaggctgagccacagttccctgctggttgtttttaatattttgctattataaacaatgctgcaatgaatagccttgtacatgtgtatatttgtattattgtaggcatgtcttcaggtaaattccttaaagtggggttgctggattaaaaggtaaatacttttgtagttattaaatgttaccagattaccctccaaaaagattggatcaatttgtagtcctcctaacaaagtgtggaaaggcccttcttccccaccaagagaatgtgttataatttttgccaattgtcttataaatgaatttggacatctttcttaagcttaaggaacatttaaaaagctttatttgtaaattgtctccttatgtatttttcctattttccattaggctttttttcagttatctcttaatttaagaggtctatatattagggatattaggcctttatgatacatgttgcaaatatttttttctaatttatcagctgtcttttcattttgttcatttattattttttttaacttccaagcttaattgagtttttaatttctgctattatttttaattttcaagacccctttcttgtttttggccattcctttagaaaaagaataacaccctgttcttttttttcaatggatgtaatatttgcttttgcttctttgagatagtattagttttttttttttttttttgagacagtcttggtctgtcacccaggctggagtgcagtggctcaattttggctcactgcagccttcagaactcccaggttcaagcaattctcgtgtctcagcctcccgagtagctgggattacaagcacgtgccaccacacctggctaatttttttgtatttttagtagggttggggttttaccttgttggccaggttggtctcgaactcctgacctcaagtgatccgcctgtcttggcctcccaaagtgctgggattataggtgtgagccaccacactcagccccctctttttttttaattgtggtaaaatatacataacataaaatttactattttgaccatttttaggtgtacagttcattggcattaaagtacattcgcattgctgtgcaaccatcaccaccattcatctccaggaacctttttatcttcccaaactgaaattctgtacccattaagcaataactcccttttctccccctccctgttggtttataaaagttgactttatatagtttttgcttttatctgtttgttttggtctgtttttatccctagacatctggtgattcttggtcatcctttattttttattttatttttttgagacagagtcttgctctgtcgcccaggctagactgcagtggtgcgatctcagttcaccacaacctctgcctcccaggttcaggcaattcctgtgcctcagcctcccaagtagctgggattacaggcatgcaccaccatgcccagctaatttttgtatttttaatagagatggggttttgccatgttggccaggctggtctcgaactcctgacctcaagtgctctgcccaccttggcctcccgaagtattgggattacaggcgtgagccaccatgcccagcccgtctagttgtttttaataatgaccactaagaaactgcttgggaactcttaacacatggtggaatgtgtcaactttggggtacactgtgggccattttgtggggtaatatctgtatctttatggattttttttttttttttggtggactagttatagtctccagaaaagaatcttcagtctgcttgtatgggtgagacagactgctagcattctgggagatgagtggcaaagtgtgttcggagtctcatatgcagtatataattccatcttcaaattatgcctggagtccctgtgtctgcagactttccattttactcttttttgcattttacatttcactattttatctaaaggataaacttccaatcttgggtgggggagggtcacttacctgccatgtggagttaagtagggatctggagtctaactgcttcttaaactttaggccaccctattgagtcattgttcagacttattttgttgtgacatccccaaatatcactatctgttggttttttctccgtgaatgatctgttttcccccagggactagtcgccttcttgtgggtatagagcttcttgccagtcttatggaagctgagtggggaagggcctggaggggaattcacggtgtaaactcatttatcctcctggtatacccctgtgctcagctgtacatgatatactggactatcctgggtcatcctcctcagaaagtgaaactttcatcatctgccacggtaggagatggtatctaggagtttcactgcttcttattcagactttgagccagcgtttccttttcaacaccacccatactcctgactttcataggtatatgttgcctctgcttctgagcctttctgctttctgaggtcctatagctgctgcttttttttttggagacagagcttcactcttgtctcccaggctggagtgcagtggcgcaatcttggctcactgcaacctccacctcccaggttcaagcaattcttctgcctcagcctcccaagtagctgagattacaggcactcatcatcatgcctggctaattatttttgtatttttagtagagacggggtttcaccatgttggccagtctggtctcgaactcctgacctcaggtaatccatctgcttcggcttcccaaagtgctgggattacaggcatgggccaccacacctggccctgtgttctcatgtgtaaaatgaaggacggggaagggagaggagaccaaataccacttaagactgattccatattgacttaattataatttgctcatagcaaaataattagtttcatacagcagatttttaaaagagcaggtacttttgttctgtatagtcatgcaccagtagatatttagtaaatacatgtgaggtcagcatctcaagagggaagccacgctcctctgttaccagtcaaagactctgggtagccatgcaaggacaggactttatcaaatgctctcacccagtgatggttctggatctcaagtgaatataagaaaaaagaaccaacacaagcatacacacatatactgcaggaacacactctagaagtagatggaaatgaatgacagtcaaatccaaacaataacttcccctcaggatttaataaaatctaatattagcgaaggctctttagtctagaaagaaaggcaccagtcactgcaggtagagtggaagaaagactatgaaacagaagccaatattctaatttcagcttgacaacagtttactcagaagtgctgtattacctttctgtgtataagttttctctggggaaaaaaatggaggactgaacacatgtttacctcagttccctctccaaatcacactgaggttacagaaatcagtttttttttgttttttttttttttgagatggagtttcgctcttgtcacccaggctggagtgcagtggcgcgatttttggctcagtgcaacctccacctcccaggttcaagcaattctcctgcctcagcctcaccaggagctggtgtcaggtgtgaggattacaagcaatccttgcaccttggcttcccagagtgctgggattgcaggtgtgagccactgcgcctggtcgaaaatgattcttaagtttatttttctcagaggcaggtgtacagcaaatggctttttgttagactactcatgtcctccctcctctccagttttcattgtgatgaaaaccttggtcagataagatttcattgtgtccaatagtctaaattgaagtatatgtactctttttttttctcaattttctgccttagttactgtgaatatgtcttcatgaccttatttttagatagaaatataacttacttctcttctttacagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaaagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggtatgcacttttcctttattctccctcaaactccaagctcacatttgctgtgcattatccttgctaataagagtcctatttttttctcccactcatgaatatttctttaaaccagttagtctgcttgaagccttttatattgctgcattatgtagatgttccatcatttaatccttgtagacacttgcattgattccatttttttcataagctaatagtgcgatgaaattatgtctttacatttatacatttgtttctgtaagctaaattctcattattagaattgatggtgaaggaatattcacacttaaaattttaagataattaagttaccctccaaaaagttgaaccagtttacatttgttaagctttggcagtcttacagatcacagagttttgttttaatttgcatttttgagttttaagtttgaacatctgtttctgtgtttattggccacttttttgtatgtgcatggttttcctttgcctatttttcttttttttgagatggagtcttactctgtcgccaggctggagtgcaatggtgagatcttggctcaccacaacctccacctcctgggttcaagtgattctcctgtctcaaccccccgagtagttgggattacaggcacccgccaccatgcctggctaatttttgtatttttagtagagatggggtttcaccatgttggccaggctggtctcgacctcctgacctcacgtgatccacccaccttggcctcccaaaatgctgggattacaggcgtgagacaccgtgccctgcccctttgcctatttttcaactggattgtttctgtttttttttttttaatataggagacgctcaatgtaccaggcactgtgctggttcctaagaatgtagcaatgaacagaatatatgaccttcagggaacttggtgtcattctagtcataaaaatgtttaattgctgattataaatgtcataagaatggtccctcacgaaaggtaaaagccttcagtaccccaaaattgtttgatatttttgcttaataggagttttcagttcttacatagtaaaacttatctgtctttttttattttttattttttggagatggagtcttgctctgtcacccaggctggagtgcagtgacgcaatctcggctcactgcaacctctgcttcccggttcaagcagttctcctgcctcagcctcccaagtagctgagactacaggcacacgctaccatgcccggctaattttttgtattttagtagagacagtgtttcaccatgttgcccaggctggtctcgaactcctgagctcaggcaatctgcccgcctcggccagtctgcctaaagtgctaggattacaggcatgagccactgcgcctggcctaaagcttacctatatttgactttgaggcttctagtttttacgtcatgctttaagaagccttctcttgtcaaaaatctatcccataaggtaaactggtgtaaacatttctttggaagacaatatgatagtataaattatggcccattcaggcaatagtttgctagcagctgtttaagaatatagatctatattttgatactgaaagatgtctatataaagtgaaaacaggccaggtgctgtggctcacgcctgtaatcccaacactttgggaggccgaggtgggcggatcacctgaggtcaggagttcaagacgaggctgatcaacatggtgaaaccccatctctactaaaaatacaaaaatcagccaggtgttgtggtgcgtgtctgtgatcccagctacttaggaggctgaggcagggagaatcgcttgaacctgggaggcggaggttgcagtgagcttaggttatgccaccgtgctccagcctgggcgacagagcgagactctctcacaaaaaaaaaagaaagaaaaaaagtgaaaacagtaagttgcaaaatggtatgaaaccattttgttaaaagatatatatgacatatgtaggatgagtgtgagtatatatgtgtgcatatgcatttgtataggacatctggacagatattattaccattggctttggggagctagttaggaggtttatttcttggtagttgaaacagttctgagcactttctctttccaaccattaagtataataaattcttctggctgggcacggtggctcatgcctgttatcccagcactttgggaggccgaggcgggcggatcatgaggtcaggagatcgagaccatcctggctaacatggtgaaaccccgtccctactaaaaatttaaaaaattagccgggcgtggtggcaggcgcctgtagtccccactacttgggaggccaagacaggagaatggtgtgaacgggggaggcggagcttgcattgagctgagatcgtgccactgcactccagcctgggcgacagagcaagactctgtctcaaaaaaaataaaaataaataaattagtaaataaattcttcctcatagaaagacacaaagtacagagtcctagcaaattaaaaaaaaaaacaacaccaaaaaacctcttgtctatactgtcctagagtaaagccagatttccctactgaggttagcagacccatgatacttacacctgaaaagaattagcatttacccacaaatgccagttaacctttatagatgtaacactttcaagtacggttgataaattgaatatgcacgtagtaaaacctgtagcatgacctgaggaagtaggaattcttacagaattcatgtgtagtgacaatataattcactattttaataggccaaaggggaaaaaaatggtatctcagcaagtgctgaaaaacctgttagtaaaattgtttccttttgggtttaaatctcttagaaaactagtaataaaggaagcttccttgaattactaaagaatatcaatcagaagccaatagcagtttcaggtttaagagaatgaagtaagctcatggactctcttcttcctcctaccaaatccatagaaattatgaaaaaatattaaaaacacatgtgtcttcatactcacaaatgaggagacagttttggtagatcagaaactgagaatcagctcccactgggcaaaaagtagagggaaggtccaggcgggcagaaggaagattagtacagggaagtggtgtgatactgagtgctcatatttctggagatggtggaagtggagaggaaaggggacacccatggtaaggactgagtagttggggaatctctccctgcctgtgccacatgtcagcaaagaacaaatctgttatcaagccaaaattctaaggacaagagacaggatactcacccacacacgtacaccttgtaacacttggcaagagtgaggaacatccattttcagaacagctgctggggttcttagtgtccttattcccactgaaaatagttcaaggcagagcagcagctactgcccattatagccctttgccctcaattctcagcaagttacctaagtagagatgaactaacagtctatcaccatcctctgagaaaagccaacacaatgaaatagacaaattcagcaaataacagaactaaacctcagtattgattaatggggcaatgagtacaatagataatcctttaagggacttctacaacattagccactattgagttctgtggggtgctgaatgctggcttgtctctaatatgactgcacattatgctcctttcagttgatttacatgtttaagagtcagttatacttaggggagatttacttgttgcagtttcataattttattcagtattacataaaatgatgaaatatgagtgtaagaagaaagctcctcctttgaaaaacaaggtgaatactttgcaatgacagtagcgggttgctgcaaaaaaatgaatgctgatgcgctcatgcaggacagctgcaaaagatttgagggcgtgcgtgaaagtctaggactctgcactgagattactttgcaagttctttaagttcttgcttcgctttaaagttctaacctctatgtcatgagtatgccaggagataatggaagggaaactgaagaaattaggaatgttttctagaactgaaaagaaaggtctgagtctaaagttgaaaggctttgcaagtgccaatcaggattaaaacacacaaatacatacacaaactcacactaaatttagtgtagtaaaattatagcacatccaagagaaataacttggatggttacttcttttggagggaaaagggatagattcctgtgccgcaaaacattccagatggattaaaagtttggctaattaaaaccaaatacacagaaatgtgtacacgaatgcttgtaacagcattgttcataatatccagaaagtgaaaacaacctaaatgttcaacacctgatgaatggataaataaaatttggtatatctatacaatggaatattattctataaaaggaataaacaccgatatatacttaaatgtggatgcaccttggaagcatgctaagtgaaaagccagacacaaaaggccttataacatatgatttcgttcatttgaaatgtccagaataggcaaatacatagagatataaagtagattaatagttgccaggagctgggaagaaggggaatgagaggtgactgttaatgggtatagagtttctttgtggggtaatggaggtgttctggaattaggtagtagtgatagttacacaatctgaatatattaaaaaacagtgaattgtgttctttaatggggcaaattttgtggtgtgtgaatcacatctcaataaagctgttaaaaagaaacaaatataggccggccatggtggctcacatctgtaatcccagcactttaggaggctgaggcagaaggatcgcttgagggcaggagtttgagaccagcctgggcaacatagcgatataaatacatagagggatgtatatagatttagcgagactctattgctacaaaaaataaaattatctgcatgtggtggtgcatgcctgtagtcccagctcctcagatggatgaggtgggaggactgcttgaagccaggagtttgaggttgaagtgagctatggtagctcgactgcattccacgctgggtgacagcaagaccttgtctctctcttttttttgagacggagtctcactctttctcccaggctggagtgcagtggcgtgatctttgcttactgcaacctctgccttctgggttcaagcgattctcctgcctcagcctccggagtagctgggactataggcatgtgccaccacgcccggctaattttttgtatttttagtagagacggggtttcactgtgttagccaggatggtctcaatctcctgacctcatgatccacctgcctcagcctcccaaagtgctgggattacaggcgtgagtcaccgcgcccggccgaccttgactcttaaaaaaagaaaaaaaaaatacaggaaatcattctttttaagtttttggtttctttgtttgtgacagagtctccctctgtctcccaggctagagtgcagaggcgtgatctcagctcactgcaaactccgcctcccgggttcaagcgattctcgtgcctcagcctctggagtagccaggaccacagaggtgcgccactatatgcctggctaattttttgtatttttagtagagatggggtttcaccatgttggccaggctggtcttgaactcctcacctcaagtgatccgcccggcttagcctcccaaagtgctgggattacaggcatgagccactgtgcctgacctaaagattatttttaattgacaaaattctatatatttatggggtacaatgtgatgttttgatatatgtttactttgtgaagtaaatcaagataatcagcatatccatcactcacttcgtcgtgagaacatttaaaatcaattctcatctattttcaagacacagtacattattattaactatagtcaccagactgtacaatagatctctaggaccacttcctcctgtctaacggaagctttatgacccttgaccaacatcttccaattctctgccccacccccagcccctggtaactaccgttgattctctacgtctatgagtttgactttagattccacatgtaagtgagatcatgcagtatatttttttgtgtctggcatatttcacatattatgctccagattcatccatgttgcagatgacaggatgttttaaggctgaattgtattccattgtgtatatatactacattttctttctccattcatccactcatgggcattgaggttgatgccatgtcttggctattgtggatagtgccgcagtgagtatggggtgcaggtacctcttcaacacactgattttattgtctttgaaatacactcagaaatggaattgctggatcatatggtagttctatttttaattttttgaggaacctgtatactgttttccttcatggctgtgctaattcacattcccaccaacagtgtacagggttcccctttctccacattcaagtcctttgcctgctttttaaattgggttatgttcttgctattcgttgtttgagcaggagaccatttttataatcttatattgataagacatttttgcccataataggaagctcagaagcaatgaaaatataccaaattgactctacagacatttaaatcttgtgtgcatgtgtgtgtgtatagcaaaagttagatgaaaatttaaaaatttagatatgcatgcccttttacccagaaatttaacttgtagtaggtgtgtccaagggaaacagtagaactaggatagatcaagagttttaattgttacattatttagaggtaaaaataaatggccatcagtagggaattggttacaatacagtatgcattttttcaggcaaaagagaactgtccatgatatagtgaatggaaaaaagcagcttcaagaagagtaagtttaggccgggcgcggtggctcatgcctgtaatcccagcactttgggaggccgaggtgggtggatcacctgaggtcaggagttcaagactagcctgaccaatatggtgaaactccgtctctactaaaaatacaaaaattagccaggcatggtggcatgcgcctgtagtcccagctacttgggaggctgagacaggagaattgcttgtacttgtgagttggaggttgcagtgagttgagatcgcaccactgcactccagcctgggtgacagagtgagactctgtctcaaaaaaaaaaaaaaaaaatttagtgtgtttaagaaatacatgttcaaagggcttgaaagtccagaaggaattatgggctcactgccatttatttaaaaatatttatggtcgtgtatgagaaaaaataactacttaaaaggttgtttccacatataaagtaaatgtttataaaaatgtccaactctttttttctagatattaatgtggtttttttttttttttttttttctggagacagagttttgatcttgttgcccaggctggagtgcagtggcgtgatctcggctcacggtggcctccacttcctgggttcaagcaattttcctgcctcagcctcccgattagttgggatgacaggtgcccgccaccacgcccggctaattttgtatttttagtagagacagggtttctccatgttggtcaggcttgtctcaaactcccaaactcaggtgatccgcccgccttatcctcccaaagtgctgggattacaaatgtgagctactgcccccggcctaatgtgttatttttaatttagtgctttggaaaaaagttaaggtagatccttacctcattctttacaccaaaatgaattccagctgttaataaaatatttagttgcgagttctttttttttttttaaatttattcccatgggtctgggaaccaatgaaattagttggtagttctaatactgtttattgagtgatttgctcttttccctgtggttcagaaatgcaacctaccacagagtctctttggatttgatctctattccatgctggctctatttgccttaattagcgtagttttatcatttgacaggacctggcgctccttattcacctctctcctttaattcttttcaaaaatttctaggaatttctcacatttttgtcccaaggtaaattttggatttattttgtaatcttttaaaaaagtatggtttttacttgttgttgcattatatttatagattaatttagggacagttgctttcattgcaaaagacttcctgtcccttagtcatatttcgcatcttttcacttaggttttgcgcattgcttatgtttgttcttagatactgtataccttccttactgctgatgggcccgttctgaggtatgcactgtgttttgttggagaaccatgtgcttgcatttcttacgtgcacagcacggggaacctcattccacatccagggtggaatgtgacccaggtcagttgcatcaaacgaaaactgtccagtgccgttagtttaacatgatggctacttttaacttctttttttttttttttttttgagacggagtcttactctgtcacccaggctggagtgcagtggcataatctcagctcgctgcaagctccgcctcccatgttcacgccattctcctgcctcccgagtagctgggactacaggcgcccgccaccatgcccggctaattttttgtattttttagtagagacagggttccaccatgttagccaggatggtctcgatctcctgacctcgtgatccacccgcttcggcttcccaaagtgctgggattacaggcgtaagccaccgcgcccggccttactttaacttcttttttttaaaaagttcttttttattttttcagttatttttgaggcagggtctcgttctgttgcccaagttggagtgccgtggtgggatcttggctcactgcagtctttgcctcccaggctcaacccatcctcccacctcaccctcccgagtagctgggactacaggcatgtgccaacatgcttggctaatttttgtattttttgtagagaagcggtctcactttgttgcccagactggtcttgaacttctgagcttaagcaatccttctgtctcagcctcccaaagtgttaggattacaggcatgagccaccgtgcctggccgggtactttaaattctaaaatgacacctcaggttttgttttttatattactaccttttgtacttgcagagtgctctgtaatttgaactccagtttttgtttgttgtttattcctaacattttatcctttgtttcttgggtcactttgaaattttagtactttgggagtaaaataaattgtgtataccaattgcatttttccttttttagttgatcagtttagtgaaagcaagtgggtaaagaatggtggatttaactgtcattttataaaatctgtttctgagtaaaataaattgtatataccaagtgcatttttccttttttaattgattagtttaatgaaagcaagtggataaagaatggtggatttaactgtcattttataaaatctgtttctggatagttcttggcccacagatattaaaaaggaaaggtgaagaaccaagttgtttttgtagagaaaagataacagatatttcttgctttgtaagtggcatgacatgatagttaacagcccagtttctgtagtcacggtacctacaatcaggatcttagttctaccatatgctagttaagtgcccttggggaggtaacaacctctcaaagcttctaatgtctccatttgattgactggttgattgattgattgattgagatgaggtctcgctctgttgcccagactggagtgcagtggcataatctcggctcactacagcctctgcctcccaggttcaagcgattttcctgcctcagtctcccaagtagctgagattacaggcacgctaacatgcccggctaatttttgtagttttagcatagacagggtttcaccatgttggccaggctggtcttgaattcttgacctcaggtgatccacccgccttccaaagtgctgggattacaggcatgagccaccgcacctggcccagtgtctctatttgtaaagtagggatactatcttaacacccagggaggctataagaactaaatgagacaggctagtgcttgtcttatgagtattttttaactgttgttttacttctggtcccagtgagataatggtgtgtgtaagtgagacactgtcatctagggttctccttgaagatcgtaccttgaagggcatttctaccgaataagaaatccatgtttatcatctgaaaatgaaaataaagatacagataagaggaaaatgtgtaataatttagaatctccatcattctaccaccagaaataacattgttaacaagagcaccatgatactagtttgaaattcacatccatatcccattgtgggggacactgccttcttatttgaggagcctcaatcaaagttgtggggcctaaagtttaatttttattgttgttaggggtattattttacaacgaaaaataattctcaatgcagtttctcaaatggtgggattccttatcttccactgggcccattcccccatgtagacacaaggttatgattaggtaactgtaagatgtgaaatagtaaacactagaggcaagtatatggtctgttcctagattagaagccccaaatctttatctgataccctgatgaagttggagcatgggactatcttcctgtctactgtatttgcccaaagcctagagcagaatggacgtgagaaaggacctcttttctgtttactgtaccctgacctttgctcctatgttaagccttgaaaattgagaggtactctggtgggagattaacaggaggaaaaataaattgttcacttctttgtctgtctctcccctcataaaagacaaaacacttcattcccaagacactcttatcatcttttctatcctgtttatatcaatgcatggcagaggccattcttggagttacaaagggagctggttaagatatgtggctaacaatcctcatttttcctgtcttaactcagcagacttaaccgtcagactgatggttagctaatttgttgctctgcccattcagcattggtgaacaacctaagtcatgtctgtacttctgtgagcgtctaagccttgcctcagcttttttgtatttacttagaaataatgtcctgggtggccaggcgcggtggctcacacctgtaatctcagtactttgggaagacaaggcaggtggatcacctgaggtcaggagttcgagaccagcctggccaacatggtgaaaccccgtctctacaaaaaaaaaaaatacaaaaattagctgggcgtggtggcgggcgcctgtaatcccagctactcacgaggctgaggtaggagaatcacttgaacccaggaggggtgggttgcagtgagccgaaatcgcaccattgcactccagcctgggtgaaaagagcaaggctttgtcttaaaaaaaaagaaaaaagaaaagaaagaacgtcctgggtttatttcctggggcttttctaggttcagtggatcattcagggatatatataagcacatatacatgttacttacatttacctgaagactgtcctatggtgtggccaaaaagccacctttaaattttatttctcatcttgggaggctggagcgaaaggatcacttgaggccagaagttcaagaccagcctgagcaacatagcaagaccctcatcttaaaaaaaaaaaattaaaaaattagctgggtgtggtttcacttgcctatagtcccagctaactatccaagcaggaggatggcttgagcccaggagtttgaggctgtagtgagctatgattgtgttactatgccccagctgggatgatagaaagagaccccatctccaaaaaattctatttactgtcttaaaatgtgcttcactagctgggtgtggtggctcacgcctgtaatcccagcactttctgaggccgaggcgggcggatcacaaggtcaggagatcaagaccaccctggctaacacggtgaaacccctcgatgatagttccattcgattctatgcgatgattccattccattccattggaagatgattccattcgagaccattcgatgattgcattcaattcattcgatgacgattccattcaattccgttcaatgattccattagattccatttgatgatgattccattcgtctctactaaaaatacaaaaaaattagccgggcgtggtggcaggcgcctgtagtcacagctatttgggaggatgaggcaggagaatggcgtgaacccgggaggtggagcttgtagtgagcagagatcgtgccactgcactccagcctgggcaacagagcgagacgccatctcaaaaaaaaaaaaaaaaaagtgcctcactagctgttatccagttgagctcacctcacagcgttatttggtgtcatgagtataataacttatcaagatgtatgatattgtcccttgctgatactaaagtacatacctttaccaaataatagagtcacagtgatctcatcagttaatgctaattgtgattttaaaataataattctttcagttaccaaaaggataggcacatttgactatgtgattaagccctttagaagtcacgctttaagagaaggttaagctgtgggaagctgttagtatttccttctagctatccattccttctctaacaatgcttcagtaacttaaaaatctaatgtgaaatgattcctcacagtatgtctctctagattgcattggttagagcctaatatattttattttttacaaaagacataactttaaaaatatagtatcaatattatatagtaatataggttaaccactgtatgtgttaagtgctgtgtataggttaagtgtttggagaatgactctactgaaaatggcttgtttttccatcttaacttttctttcttcctttatttaaggattcctagatgaggttatgaagaagtatggcagtttggttccactcagtgaaaaagaagtccttggaagattaaaagatgtctttaatgaagacttttctaataggtatataaatgatgctaaagttaagcccttgaaaataaaatttttggcatatatgacttttctcttgatttacagaagaaaagatatttagcagtaaattgagaagtactcatgttttttttaccttttgtttcaaaatctttctctttcagaaaaccatttatcaatagggaaataacaaactatcgggccagacatcaaaaatgtaacttccgtatcttctataataaacacatgctggatatggacgacctggcgactctggatggtcagaactggctgaatgaccaggttagtatattgtagtttttcagtgtggagaagttgcagaggatgttagtcaataaaatataatctctagtttggcttctcagttgtcttttggaataaggattcttcattctttactggttacttgccccaggatccaaacggtttgattactattggcagtaataatatattatttattctgattgggatgtactgaattgtatagggttagtagcctggttttatttatttattttgtttttctttctccaacttaactggcagagatagtaagctggttttatgttgactttttataggtcattaatatgtatggtgagctgataatggatgcagtcccagacaaagtaagtgaaaacttcctcttctgcaggagagagtgttcttgtgtattaaaatgagtagtttttttgtttttacatttgatgtaattatctgacattccttaaattttttaaaagaagagttcaattttttcttgatcatgtactgggcttgatcgtaagttccatcaaatcacttctttttgttctttttgagatggagttttgctcttgttgcccaggctggagtgcagtggcgtgatctcggctcattgcaacctccacctcccgggttcaagcgattctcctgtctcagcctcccgactagctgggattataggcatgtgccaccatgcctggctaatttttgtatttttagtagagacagggtttcatcatattggtcaggctggtctcgaactcctgacctcaggtgatccacctctgccttggtctcccaaagtgctgggattacaggtgtgagccacagcgcctggccccatcaaatcacttcagcataagaaaatcactgtgcaattgttttcctatttatttgtgttagggtaggtatgtttgttgatatctggagagggcctttttttggtggggagatgtgcaaaagggactggctaagctttttacatttatgtatttattttacttttttttttttttgagaccgagtcttgctctgtcatccagactggagtgtagtggcgtggtcttggctcactgcaacctccacctcctgggttcaagcaattctcctgccttagcctcccaagtagctgggattacaggtgtgtgccaccatgcctggctaatttttgtatttttaggagagacaggtcttaccatgttgggcaggctggtctcgaactcctgacctctggtgatccgcccacctccccctcccaaagtgctgggattaaagatgtgagccaccatgccaggccagctttttacatttaacttaaaatcttgctctctttaaaaatgtaaaaaaaaactcatctttcatttttccttagataaatctttgatactcagttcaaatacagattgaaccctcataaactctaaattctcttaagagttttgttacatatcaaaactatttttttacttaatgtatttttctgagtacacaaatgcctgatgggtgcaaaaatttccaagtgctgtataaaacttaccaatctaataaagtaacataaatactaaaaagtcagattctgataccgtttatgaatatagaaaatgttttatgactttccacttaaattataaatctgttatacatttataaattggaatcatgaggctaatctgctagatgctctattgtcaaattctcttaatcatcagaaagtttaaacaatatagattatctttaacataaaagtattaatttcaagggtttcatttaccaccattgtacatttaattctaaacattcatggagtcaaaaggacacttaactaaggcagtggttctcaaagcatggtccccatactagcagcatcagtatcccctgagaacttactagaaatgcacattctgagactccatcccacacctactgaatcagaaactggaggtgggggaccaccgatttgtgttttgacaagctctctagatgattctgatggacaccaattttgagaatcactgctctagagacagctactataagctctttcttatttatttgtttttattaaaattataaaacataaccttctttttagagacactaaaaagacactccaggctggaatgcagtggcacagtcatagctcactgtagccttgaactcctgggctcaagcaatcttctcgccttagcctcccaggtagctgggactagaggcatgtgccactgtgctactatacccagctagtttatttttatttttggtagagccaggagtcttgctatgttgcccaggctagcttgagctctgggcttagctaaagtaatcctctcacctctgcctctcaaaattgctgggattagaagtgtgagccactatgtctggcagctctttcagtctgtatgttaagctgcatggttatcaaaagaatgtgcctcagaaccgtctgaaaggtttataaaaccagattactgggccctgccttcagagtttctgctttaataggtctgggatgaggcctgataatttggatttctaacaagttcctagatgatgctgacactactggtcaggtgaccacactctgagaaccacagtgctaagggaacagttttatcacctcaagttactgaatgagcactttaagatcacaatatgtttaccctctaagatgagctgatataccacttacttataagtcagaaattcaaagccaaggacgcaggacctgatactctgtacagccagggtaattctgtggtactagaaataatcatgccaaggcctttttatggttactgtaacaacaggagtctctaaatccacatccttcacatggagttagttttgtaatccatctcccttgagttcaaggtaattgttacctcattttttcatagcctctttcagctttttcacctgatttagagagatttgtcaggttgcttctctacttgattggattcaggtagtctatttactgccccattccaaagctgactatagaccacagctgtaaggtcattccaataaaactttggaacagcattttctgtaaaccatgtaatgtattttctatattttgatcattattatcattattattattttttgagacggagttttgctctggtgcccatgctggagtgcagtgatgtgatctcagctcactacaacctctgcctcccaggttcaagagattctcctacctcagcctcctgagtagctgggattgcagatgggtgccaccacgcccggctaatttttgtatttttaggagagacagtgtctcaccatgttggccaggctggcctcgaactcctgaccccagatgatccacttgcctcctcaatcattgtttttatgaagaaatttttccttcctttttgtctgctttacattcaaacattttaaaatttcctcttttgaagttaaatctgggcacagcctaatataatctggttgcttgtgtttgttgtctgttctaggttcacttcttcaacagcttttttcatagacagctggtaaccaaaggatataatggagtaaaaagatggactaaaaaggtattctctttatttcttttttattccaaatttgaaacgcagatgataaaccactttgtgtggaaggataagtactttaatgccaatacgatgttaagtagaaacagactttttaatgtgacaagttttaaatttgtttcttttaaatcttattgtttgaaagaccttaattgcctactggtcccaattatagtggtagaacagtgggatgataaagaaggagctgccatcatttggtgttatctggtaggcttgtcagcagacagcagaagctttcaacaattttttgctggtgctgggcacggtgcctcgcacctgttgtcccagctacttgggatgctgagaccagaggatcacttgagcacaagcatttgaggccagcttgggcaacatagccagatcctgtctcttaaaatgttaactgatccatcaggagaaataacttttatatcacaatctattcataaaatcttatacatacatgtaattgaaataatttccaaaaaccatgtacctaatttactatgtatgatgtactctagtcagagagtggtaagtgctatttgctatggaaacatcagaacacagtatgagaatacaaggtaactgggatagggtagcaggaggaagatgggctagttcttttagataggcttgtcagcaaaggcctctttgaagagatcccatttcactgaaaactgtgaagatcagaggagcattcccagtagatggaagagtgaatgttaaaggccctgaagcagaagtgagtttggtatattggagtattacacacatgagatcagggaaggaggcagggatcaagtcatgtggcgccatataggccctggtaaagagtttggatcatgagggcaatttgaagacattagagagtttaggccaggtgcggtggctcacgcctgtaatcccagcactttgggaggctgaggtgggcggatcactgaaggtcaggagtttgagatcagcctggccaatgtggcgaaaccctatctctactgaaaatgcaaaaattagccgggctgtgatggtgggcgcctgtaaccccagctacttgggaggctgaggtgggagaatcgcttgaacatgggaggtggaggttgcagtgagccgagattgcactattgcactccagccttggtgacagagcgagactccatgtcaaaagaaaattaaataaaaaataaaaatgaagacattagagggtttaagcagcaggcaaggagtgtgtatgagtgtgtgtgtaaatgatagataggattgtccttagcaacattgattcattcattcatcatttatttattgatttattttttgagatggagtctttcaggcgctatcttcgctcactgcaacctctgcctcctgggttcaagcgattctcctgcttcagcctcctgtgcagctgggattacagtcacctgccaccgtacccggctaattcttgtatttttaatagagacgggatttcactatgttggccaggctggtctctaactcctgacctcaggcaggtgatctgcccgcctcagcctcccaaagtgttgggattacagggtaagccaccgtgcccggcattaaacatttattgagtacctgttatgtgcctatatggaaaaacttttttcctttgctgtcacaccacaacagtagtcagcacagaagacttctgtgaccaaagcaagcaagcaagcagttctgcagcgaccactggctggatgccctctaattcaattccgacctgtctacctggagacagtgccacgtcccatagtttgagggctcatgcctcaagagtgccccccacccacttcagacaccagttgcaagtccaggcttctgaaacttctgaccaacagacttcaagtgagggttcccatgccgccctccttgaatttgattaatttgccggagcggttcacagaattctgggaagttcttacctacatttagcagtttattatataggatattacaaaggattcagatgaagagatgcatgggaagagatgtaggggagtgggcacagggattctctaggacctccacaggcacatcaccctccaggaacctccacatatttagtatccagaagctctcccagtgcagtcagtttttatggaggcttcattacataggcgattgactaaaccagtgaccattggttaacctttagcttctcttctctccctggtggttggggggttgggtggggctgaaagtcacaatcctctaattctgccttgctcttatcctaaagccacctagcagctgccagccatcagttaatcatcaacatacaaaaagacatcactttgggcctgggtcatgtccccgtaatcccagcactttggaagtctgaggcaggcagatcacttgaggtcaggagttcaagatcagcctggccaacatggtggaaccctgtctctactgaaaatacaaaaattagctgggtatggtggcatgtgcctgtagtcccagctacttgggaggctgagacaggagaatcgtttgaacccaggaggtggaggttgctgtgagccgagattgcaccactgcactccagcctgggtgacagagcaagactttctaaaaaaaaagaaaaaaagacatcagaaattccaaggactttagggagttgtatgccaggaaatgaggtcaaagaccaaatttattattttacagtatcatagtgccagacattatagtaaatcaagaaataaagaggtaagtaaaacaatattagagacagtttttgctttcacaaagtctgcagtctagtggtggagacagcacctaccacagtttgtatttatatttttggtggtgtaattatttgtttagtgggtacaaaagaaaagtactacaggagtgtattggaatgcaggtttggttaacctagcctgagggtaagggaatgtttctcataggaagtaatatttaagcagaaatatcaaagatgaatacaagttaactaggtaaatggagaataggggtatgtgaaacataggcagaaggaataagtatctggtagaagaatgggaaaaggctagtgtagctgaaatgcagagagttaagaagacagtggcatgaagtgtacctgatccacagatcagggccttgaggtttgtattttggattttatcctaaatgtaataggaaaccattgaatggtttttagtgacattatccactttgtagtctttgttctaacagtactgaagaagatggatgggtatgggagcaaagttgatgtgggcagaacaggagaccatttcagattcatggtactttgaagtagaatgatagcaggagagatggaagatgagtgtgatgtaggaagtaaaattaacaggatttggtgataagttggttatggagatgaaggacaaggaagtgtgaaagatgacttccaagtatgtgacttgtatgactggacggcctatggttgtatttacattagaaaaatgtaggacaactagtagaggattgttcaaatttaaaatgtacagtcatataattggatgctacttaagcaggaaaagctgtgtagataatgaacgatgggccgggcacagtggctcacatcagtaatcccagcactttgaggggccgaggcaggcggatcacgaggtcaggagatagagaccatcctggctaacacggtgaaaccccatctctattaaaaatacaaaaaaattagccgggcgtggtgacggatgcctgtagtcccacttactcaggagactgaacccaggaggcggagcttgcagtgagccaagatcgcaccactgcactccagcctgggcgacagagagactccgtctcaaaaaaaaaaaaaaaagataatggaagatgcttatattccatttggggtgggaaaaattacaagcagtgtgggcaaaaaatatacattcatggaaaagtatctgaatgataaacatgagagtgaaagaataaagtcaaatatgtgagttgtttcattaaataataaactaaattattccttcctctagatcaggggtgtccaatcttttggcttccctgagcctcactggaagaagaagagttgtcttgggccacacataaaatacaccaacactaacaatagctgatgagctaaaacaaaaaaaattgcaaaaaagatctcataaaagaaagtctacaaatttgtgttcggctgcattcagagccgtcctgggctgcatgctgcccgtgggctgtggactggacaagcttgctgtagatcctctgagattgggttaagtaaaaaaaaaaaaaacccaggtttatgctgaatataagaagtatacataaaataatatgaaaaagaaaggttgaaaatgaagtgacatttaaagaggctgggcgctgtgtctcacatctgcagtctgaacactttgggaggcctaaaattactgtagatgggaggattgcttgagcccaagagtttcaaatcagcctaggcaaccaagcgagaccccgtttctataaaaaatttaaaaaacttagctggccatggtggcagcctgtggtcccagttatccagaaggctgcggtgggaggatcacttgagcctgggaggtcgaggctgcagtgaaccctgatcacgccactgcactcctgcctgggtgacagactgagaccttgtctcaatttaaaacaaataaaaaaggcaactacaggaaagttaaacaacctgttcctgaataactcctgggtaaataaagaaattaaggcagaaatcaagaagttctttgaaaccaatgagaacagagagacaatgtaccagaatctctgggacacagctaaagcagtgttaagagggaagtttatagcactaaatgcccacatcgaaaagctggaaagatctcagatcaacatcctgacatcacaattaaaagaactagagaagcggctgggcgtggtgactcatgcctgtaatcccagcactttgggaggctgaggcgggtagatcacctgaggtcaggagtttgagatgagcctgaccaacatggagaaaccccatctctactaaaaatacaaaattggctgggtgtggtggcacatgcctgtaatcccagctacttgggaggccgaggtaggagaatcacttgaacccgggaggtggaggttgtggtgagctgagattgcgccattgcactccagcctgggcaagaagagtgaaactctgtctcaaaacaaacaaacaaaaacaacaacaaggaaatagagaagcaagagcaaacaaatccaaaagctagcagaaaacaagaaataactaagatcagagcagaactgaaggagatagaaacacaaaaaaacccttcaaaaaatcagtgaatccaggagctggattttttgaaaaaattaacaaaaaatacctctagctaaactaaagaagaaaagagagaagaatcaaatagacacaataaaaaatgataaaggggatatcaccattgaccccacagaaatatacaaattactatcagagaatactataaagacctctacacaaataaactagaaaatctagaagaaacggataaattcctggacacatacaccttcccaagactaaatcaggaagaagtggaatgtctgaatagaccaataacaaattctgaaattgaggcagtaattaatagcctaccaaccacaaaaagcccaggaccagatggattcacagccaaattctaccagaggtacaaagaggagctgataccattccttctgaaactatttcataacaattgaaaaggaggaactcctccctagctcattttatgaggccggcatcatcctgataccaaaacctggcagagacacaaaaaaagaaaatttcaggccaatatccctgatgaacatcggtgcgaaaaattctcaataaaatgctggcaaaccaaatccagcagcacatcaaaaagcttatccaccatgatcaagttggcttcatccctgggatgcaaggctgattcaacatatgcaaatcagtaaacataatccgtcatataaacagaaccagtgacgaaaaccacatgattatttcagtagatgcagaaaagaccttcgataaaattcagcatcccttcatttaaaaactctcaataaactaggtattcatcaaacatatctcaataataagagctatttatgacaaacccatagccaatatcagtgggcaaaagctggaaacattccctttgaaaactggcacaagacaaggatgccctctcccatcacttctattcaacataatattggaagttctggccagggcaatcaggcaagagaaagaaatacagggtattcagatagaaagagaggaagtcaaattgtctcttgcagatggcatgattctatatttagaaaatgccatcgtctcagccccaaaaccccttacgttgataagaaactttagcaaagtctcaggatacaaaatcaatgtgcagaaatcacaagcattcctatacgccagcaatggacaagcagagagccaaatcatgaatgaacccccattcacaattgctacaaagagaataaaatacctaggaatacagtttataagggatgtgaaggacctcttcaaggagaactacaaaccactgctcaaggaagtaagagaggacacaaacaaatggaaaaatattccatcctcgtggataggaagaaccagtatcttgaaaatggccatactgcccaaagtaatctttttttttttttttttttttttttttttgagatggagtctcgctccattgcccaggctggaatgcagtggcatgatcgtggctcactgcaacctccacttcccgggttcaagcaattctcctgcctcagcctcccgagtaggtgggactacaggcatgcaccaccatgcccagctaattttttgtatttttagtagacacagggtttcgccgtgttagccaggatggtctcgatgtcctgacctcgtgatccgcctgcctcggccttccagagtgctgggattatagatgtgagccaccactcctggctgcccaaagtaattaatagatttaatgctattcccatcaaactaccattggcattcttcacagaattagaaaaaactactttaaaattcatatggaaacaaaaaagagcctgtatagccaagacaatcctaagcaaaaagaacaaagctgtaggcatcacatacctaacttcaaactatactacaaggctacagtagccaaaacaacgtggtattggtaccaaaacaggcatatagaccaatggaacagaacagagacctcagaaataacaccacacatacacaaccatctcatcattgacaaacccgacaaaagcaatggggaaaggattccctatttaataaatgatgctgggaaaactggctagccatatgcagaaaactgaaactggaccccttccttacaccttatacaaaaattaactcaagatgaattaaagacttaattgtaaaacacaaaatcgtaaaaaccctagaagaaaacctaggcagtaccattcaggacataggcgtgggcaaagacttcatgacaaaaacaccaaaagcaattgcagcaaaagccaacatggattctaattaaactaaagagtttctgctcagcaaaagaaactatcatcagagtgaacaggcaacctatagaattggataaaatttttgcagtctacccacctgacaaagatctaatatccagaatctacaaggaacttaagcagatttacaagaaaaataaaccatcagaaagtgggcaaaggatatgaacagacacttcgcaaaagaagacatttatgtctgtagtctcagctactcgagaggctgagacaggagaattgcttgacctgggaagtggaagttgcagtgagccaagattgcgccactgcactccagcctgggcgacagagtgagactttgtctcaaaaaaaaaaaaaaaaggacatttatgtagccaaaaaacatatgaaaaaacctcatcagttgggcgcggtggctcacgcctgtaatcccagcactttgggaagctgaggcagttgtggtggtgggggcctgtaatcccagctactcgggaggctgaggcaggagaatcgcttgaacctgagaggcagaggttgcgtgagctgagattgtgccattgcactccagccttagcaacaagagcaagactccgtctcaaaaaaaaacaaaacaaaaacagctaatcactgatcattagagaaatgcaaatcaaaaccacaatgagataccatctcatgcgagtcagaaatgacaattattaaaaagtcaagaaacaatagaagctggcaaggctgtggagacataggaatgcttttacactgttggtgggaacgtaagttagttcaaccattgtggaagacagagtggcaattcctcaaggatctagaaccagaaatatcatttgacccagcagtcctattactgggtatatacccaaaggaatataaatcattctctatagagacatatgcgtgtgtatatttattgcagtactcatagcaaagacatggaaccaacccaaatgcctatcagtgatagactacataaagagaatgtggtacatacgcaccatggaatactatgcagccatttaaagaatgagatcatgtcctttgaagggacaaggatgaagctggaagccatcatcctcagcaaactaacagaggaacagaaaaccaaacactgcatgttctcactcataagtgggagttgtacaataagaacacatggacatagggaggggaacaacatacaccggggcctgtcagggggttgggggcaaagagagggagagcattaggacaaatacctaatgcatgcagggcttaagacctagatgacagcggggtgcggtggttcatgcctgtaatccagcctgggtgacagagcaagactctgtctcaattaaaaagaaaaaaacaaaactagatgacggattgataagtgcagcaaaccaccacggcacatgtatacctatgtaacaaacctgcctgttctgcacatgtatcccggaactttaaaattttttgaaaattcaagttttcattaaaagaaaaaataaaaggtactaggcagctgggcgtggtggtgtgtgcctgtagtctctgctactccggaggctgaggtgggaggattgcttgagcccaggagtttgagactgcggtgagcagtggtcacaccactgtaccccagcctgggtgacagaccttgcctctaaaaataataatttgtttgaaaattgtagaaatttaaaggtactagacaaattgaaacaaaaacagaaaggaatattaatcatattaatagcagttgaaatagaatttaaggtgagaagcaaattgtgtaattatcagatttcaatataaaggagatataatgaccaatctttatgcaccaaagcacacagttgctaaatatgtgtaatacaattaaaacagaaacaagaggaccttggtaaaatagtgatagtggcagacttttctcataagtggataaatctagtagacaataaagacatatacaaaaattacagtcaatataattgatttaatagatgtttatgctccttaagagaatatacatttattgctatggttcaggaatatttgtaaaaattgaacatgtacttagccacaaagaaaattattttttattagccgggcaaggtggcatttgggagcccgaggcaggtgaatcatggggtcaggagttcaagaccagcctggccaagatagtgaaacctcttttctactaaaaatccaagaaaattagctgggtgtggtggtgtgcgcctgtaatcccagctattcgggaggctgaggcagagaatttcttaaacccaggaggcggaggttgcagtgagctgagatcatgccactgcactccagcctgggtgacagagtgagactccatctcaaaaaaaaaaaacaaaaaaaactagtaagaccctgaactcagtagaagactcagtgatgaaaaggtttataagaaaggcttttttttttttttttttttttgatggagtgttgctcttttgcccaggctggagtgcagtggcacaatcttggcttgctgcaacctctgcctcctgggttcaagcgattctcctgcctcagcctcccaagtagctgggattacaggtacacaccaccacacctggctaatttttgtatttttagtagagacaggttttgccacattggctaggctggtctcgaactcctggcctcaagtgatctgcctgcctcagcctcccaaagtgctgggattacaggcatgagccactgtgcctggccaagaaaggctcttaaacatataaaaagttgcataacttcacagtaaaagaaaagcaaatgaaaaccacactgagtgacagataaatgcagtaagttaatcttgattggatcctggactggaagagatgcaatattttgggtaaattaggggaaattttagtatagactaatatattcaggggtcagtgatctttttctgaaagagccagataataaatactttggattttgcagaccttatggtctttgatttatctactgacctgttacagcacagaagcagatgtagataatacccaagtaatgagtgtggctgtgtttcaattaaacttaataaaaactggcagtgggccatacttggtcattcatgcattagatgatattagtaaactgatgttaaatatcttgt

SEQ ID NO: 31 - DNA, 95856 bp, Homo sapiens
gcctcatcctatacaagataaaattgtggtaagaagacacattaggcttttgaagatgggtcttgaactttttggaaagccttcactacatgctggccagtgttaagttggtttagtatgccaaggactgcttaggcaaagaagcagatttttaggtacaaacctagagagcatttacaacagaggaaaatgggtacagtccccaggtctgcaggacaggaaacgtgggtcctgtgtgaacacataatcgggggagagcgctcattcactgagtactcgctatgccatcggattgaatcctccactagctcggtgaggtacatactatgcccatttaacagatgaggaaacagatggtcagagagctcagataagaagcccagggtctcaccatgtagaatctggatgcagggccaagttgtcttggaactggaatttggaacacctgacatgcttggttctttatttcctgctgtttcctgagggaactgacctgcccaagcaggaccaaaaggctaccccatgaagaaaagctctgctactggatcattgttctcatctctctctgggtctctgctcagtggaggcagaaaaggtgcttttccatttctattgcctgacttcctctccattcacatggtaagtgttgtctacatgcttgctgagagaacaactggaagatgagtgaatgtgtgtagactgtgtttcctaatgtgtgaaatgtgtactggtatctgagatgatttaagattgtgccacctttataaaaatagatccacctttattttagtggatcattaacatacattagaaaaaaatcattaacacagcctgggctttcacaaataatattgcttgaaatatggctgagtttaaaaacttgaattgattattaaaatacattaagtagacgacactcatgcatgacaactacaggaggtgttaataggaataattgaagttagggagctctacccaaggaggcaaattcatattaattcctaacatttattgagtacttggtaagtgccaaacactattctctgttttaccttatctgcttaaatcctctcaacaaccctgcgaagtatcttacctccatcttatagaggaggaaactgaggcagagagcaaggtctagctaagggtcgcaatcattagcatgagaatttgaactgaagcagttggactccagggatcaaacccccaccttgaacacaagataaagctggagttagggggtaacaacgtggagcctctggagagctcaagggtttttgattcaacagtccaaaatgaggaggcagatgcagttagcactggagaggagggagttacccatgagggaacccagggaggaaaagttattcctcaaatgcacatgggctccgggctgcagcccaagagcttcagccaaaacaggagccaaggtcttctaacccctctcccttcttccacgctttgttttgctggggttattttagttcttgctactgcaaggtcaggaacattcccaactggcaattggtctccaagtgccctcagcatggactcagtcccttgcaccagtcagcatcctttgaatgcagtctatatttgtgcccaggagtttctatttgtggtggctgtttttgttttaagctctctatgcaaatgacacactaatggtctggtcctaagggaaattctgtcttcaggtgacagagaacttttcatttaaacaagtgtatctatcctttttcactaaagccactacagtcggcatctgctcattttgttcattttcctcctgaaataggttagctaatcattgcttatcacatttccaactagtttctttttttttacttgaataactatagctccaccctctatgggtttggggccatgcctttcaggcctactttgcaaactgtgctgataaaagacaagattgtgaacttgcccacattacatgggctgccaatcagcctcacatggtgtaatttaattctaatacgcctcctgatctttggtgcatttaaaaataacttgttaatagtcttcctattctaattaagctaaaattgcacacactgtgaaatgcttgctctcttgctctctcatgctctctctctctctctacacacacacacacacacacacacacacacacacacacaattgatccttaaaaatcatttctgtaaactgcctgtgtagcacagtgcttctgaaattctcctgtgtcttcccctgacctatgcccacaatgatagacaatagaataaaataactgtggccctggtaccctaggtccattaaaatattcataataaattgtctaaacattgataacaaagtggttaaaattggaacctctagagccaaatctcctgggttcaaatcccagctctgccactaactgtaactttgtgtaagtcttttaactgtttttatttcctggtttcttaatgtgtagaaggaggataatgatgagatctacttgggaaagttgtaagagttaaatgaaatactggttttttaaatggttagaacagagactgatgcacataagtattcattattataattcagtttttgcattctttaaagtgaagctgtgttgttgcagtattttaaggatatattgttccccaaatttttgggtaaaattgactgttaaggaagatgagtcatgtttaaactgtaattgtgagtagaccaccctttatccttgaagggctttctcaaccaggtgaatggcatggctgtggtgggaaatacagggccctgtgagacaggaaatctagggggttgtctagctccattaccatcctcttcttttatggattcagtgtcttgttcttttgttccatgtgagaatcatccctgccctgcctacgttataaagctggagaaaaatgaaataagtaaaaacacatggaaaacgtactaaaatattaatgcaaggatgcaaggtataatctttgctggaacattagttcctcatttattagtaacattacaggcatttgaaattatgtactttatatgggacctatattttaaatatatgctaatcatcctagaagccctacaaggtaggtgttacttttttccattttaccattaaggaaattatccaggtttacacaacttgaacccaggtctctgtcagtaaaaaactgtctactcttccaaaccattttatctatccatatttatttcctccatcaaacattagttgaatgcaatgtggtgtatcacccaaggtcggctggcatcttgaaaacaataactatgtgttactcagcatcttagcacctagcaaagagtggagaatataacagtctttcaattaagttttgtcgaagaaagaaatgaaggctcttggtctttagaaattcacaaatcagctgaggagacagacatactaaccaacagcatatgatcagcatgttctaattggtactgtctctggaataaaacagctggcagcaaaaaatgtctgacttttgcagagaaactcctaatatgagtttgactgctgtcccacatctacctatgtggtcgtagtgctgtagtcactgttgttaccctaagaggacagccttgttcctccaggtctcttacaactctcttttaaggagctcgtattagatccctagagctgctgtaatgcattgcccaaatcttgtgacttaaaccaacagaaatttattatctcatagttctggaggctagaagcctgaaatgaaggtgtctgcaggcttcactctctctgaaatttttatgagaacatttttcatgtgatttagagcccacctgggtaatccaggatgatatcatctcaagattcctaacttaattacacctgtaaaatccatttttccaaataaggtcatattcacaagttctgaagactaaggcatggacagatctcattggaaaccatcattcaacccactgcaaagctttagccaattcccagctatgaattcttccaagatgaaaggataccaagctcaagactctcccttgttcatttgaggccttcccaaagatgactgacattttcacaaattttatttggtttcatttcctatcttaacgaaaacaatgataatttcctatcttaatgaaaaaaatgataatgtttatactgtatgataattaaaacatcatgtaaagattactctttatctaaatgtttgcacatactctttgaacatccatcatttttccagcagttatgattttttcttcccaggaatatgggaatgaagtgaaattgacaacttttcccccacgcattgtatcctcttttaatgccaccccctgtgtttaacagcctctgacacaatgtaggagcaatccatggtactcaaagaatattatggaatttaacaacaagtatatatatttgtcttgatccagtgtcttatctgattaccttgggccacaggaataccctaggtgagaagggaaagttgggttctagcccaagtcctgttactaagtctcttagctccatgacccttggatattctagttattattactacaaaacttagcggcttaaagtaatctttttattttacataattttatgggtcagaaatttgggaaaggcttaggctggaaagttttcacttggagtttcttctaccattgcagtcatatgtcaactgggacttaaatcatctgatagctcagctaggctagatatccaagatgcctcactctggtggttagtaccagtagttgactgggatctcagttggggctgtcatctaggacaacggcacatggcttttccaagtggcagtgttaagacaatacttttaatatgacatctggcttcctctagggtgagtgtagaacctgtggaaactacacgggtatttatgacatagccttggaaatcatacaagatcacttctcccatactcgattgagccaagcagttgcaagtcacccaaattcaaagcaatgggacgtagctccccacctctcaatgggagatgtgacaaagaatttgggagcaatattttaaaaccaccacaggtactttatactatgtgagtcttgctctcctctataaaatgggactacattgtctctaagactcctctagggcttaaagtctatggggcacttccctttaataatcttaatttatagatacttacattagtatttgtattccaattcttttctatcataaaataaccgtagtacatagaatttttaaaaatagaaaaacaggcttagtttcaatgcctaaatctttatgtatttccatatttcgagttgttttctgcgtgtttgtttgtttgtggtgcttgtgtgtctgtgtgtgtgagtgtggtgaacctaccagtacatcattttggcatcttttctcagaattaaacaagccaggaagacattctgacagtttgtttttaaagaccatcagttgccattataactaaacatactatacaacagtaacatttaatatcccaattaaattgtagtagttgttgacctcagattacaaactcaggtgggccagaaatgtcttattttacaataaatctgttttaattttgattctgaacccctgtcctgctgagctggtaggaaatatagcccttcatttttgagacaaccttccccactaactcctgaggttatatcattcatccaggtctcacacagttggaacaaaggggagggggctgaagggttttggttctcaattatccatgaaaccaaattcaccctgaaatgaccattatccttatttgctgggcttgttcaggtctgcctctcttatggttcgttgccttgcagggagtttgtgattattctccaggaaacagaatatctcaggtctagacttgctttttggtgcaccacaagcaatttccttatatcctccatgtcctcagggtcctgccatggaacagtaggcaggtgccctctgctccagagatccccacaactctttctccctcaggtcctacagattccatatcctctgccttttgccttacccaggctctattcctgctcgtttcttagtagtttttgatagcctaccaaaatcattagcaaccaaataactgcttcacttcatcctgaaattttccctggagaaggaaatatttgcgttccatctttctactgcttcagagaaaagaataaccaaatgactatttttccacaataagagtgaatgttcacatcctgctacaaaagaatacataaggctaatttatatgcattgcatattctccaatatataaagggaatcgcacttccatcagatagttttttgagtctgtgtttaactgcttcctaaatcttctgggtctaacaggagaacagcgtctttcatggctgatgacactgaagaagtgccaaagaaacagcaaaatggcagatttagtgtttattgttgggataagataatacaggttcataatccctatgtgctgtttcacattcaaaagctcagaaaaatcaaaataacttctagctcattaggcttctaaacctgacctgaactaatgtgaggctacttttaagtctttatttaccacacttacggtgcatatttttatgttatataccagaaatattagtatgactgattatgggagtgttacctacttcgtgctgcagggtatcacatgttgggactcagaaaatgataccctgaaatatactgctttgaacttccaactgagaggacctgaggagcagcaaatgctgagttccttatttgactaagagaatttccttcagaaggcattaaattgtcttgccccaccccacccttcatccccataatttcatcaaacagatgagactaactcataggaaagaagattgaagctgactccacacttggagctcatacaaactttttcccaggctattgtctgttcttcaagcccattcacctcccctaaaaatcatgtattcttcctcaaaaattgtctattatcttccacttccctttcccccatgaaaagtgttgaggcttattctgagccaatatgagtgaccatggcctgagaacccaatatgagtgaccatggcctgagaaccatctcaagagctccttcaacagttgtgactgagcttgtcaggttgcagtttggttttatatattctagggagacaggaattataggtaaaatcataaatctatatatagaaggtatacattggttcagcctaaaggggtgggatatcttgaaggcagggtggaggggatgcttacagatcataggtaaattcaaagattttctgattggcagttggttgaaagagttaagttttgtctaaagacttgaagtcagtagaaacaaaaatgcttgagtaaagataaggggggttgtgagggccaaggtttttggtatgtagatgaagcttcatagatcacagtcttcagagagaatagaagataaatgtctcttttcagactttaaaggtatcagactctcagttaatctctcctagatccaagaaaagcctagaaagagaaggcctgactccattaatggagattctctacagatgcaaatttcccccacaaaagatggctttgcagagccatttcaaaacatgttaaagaaaaataaagtaaaatctgtttatttccttcagggtctgctatctgtcatgtgccatgacatgctataccagtcaggttggaattggtgtcttattgccatagtctgtttactcagtcttatgatctctattttaatgttaatgctggtcagttgcgcctaaactgcaaagggtgggagtatgatgaggcatatcagacctccattcccatcatagctgggaattcagtttttcaggtttctctgggttctccctgaactagagagggtctgtttaaagctgcatttgcaaacattatgacagtgagacaaatctagcatggctgattccaacttgcttctagcctcacatgctggctgtttttacccattcttggctataggccaagctaaccatgaaaggggactgaattctgctaagatctactttctgtagtccactactgctcaggagtcacgtggctggaggtcacaagatttgtgacttattgctcctttagataacatcactattgtagaaactaaattggccttttgagatgttttttagacttttgtgtcctggcaaccactgaccccacccagactcaggactcaactggtcctgtggcccttcacccagagtgcccctccagcacacaaggactattttccatgcccctgtgattgcatccccagctaatcagcagcacccattcattagtcccctgtccaccaaactatctttgaaaaactaacctctgagcctttagtgaggctggtatgagtgacaactgcagttctcctgtgtggtctgcctcatgtcagttaaactatttctttactgcaataccacaatctcagtgaattaattttgtccatgtaatgggcaggaagaacccaccaggcgattacatgtttagttagctgagggggcttaggattttatttttggtttataagaggggatttaagcttcaatcatctgaattgtctttgagttttcatactttttgtgactctgtgcactttcatcttaatacatttgtatgccttttctcctgttaatctgtctattatcagtttatttcagccgactcaattatcaaaccttcagaagagaagtgtaagcttccctgcacacataatatgtaccatattatcttttggaaagttctccaaaattctagctttccaaacctatcttattctagggatttgagataaggcttgggatatatatatatatatatatatatgaattagaaagtttctttttcatggtatttcttcatgtgcccattacagggacagaaaagataatttttcctctacccttgtaaattctcagctggggcctcaatataaaaagacagattaacaaaagaaaaacaaatagaagtttattaacatgtatacagtgactttttctgtaacctctgcctccccccctcccaccatgtttatagacccctgcatttaaaccatctgggacttcaggttttaaacacgagctggctgaatcttcttgcttggtaccctgcaataaatgtatacatgggagacacccagggacaaatgaggaactctcaaagagatagtttagaattcaagcataaatactatcttcagctaaagacaaaacagagaatggtgtcagggaggacgaggtaactaggaaaagtacagtaaagaagagtaagttttgtaatgcagatgtaagtcaataccttccccactgctaagagcctctagtgatttacccatctttctctttcttatacagagagggagacacacttaaaaaattgagatttactttataaatgcaaatttcccatagaaaagggtttacttctcctttattttcagagcttctcctgtgtctgctgtttctcaaaataattctgctaaagaggcatattttggggtgtcatattctggtctcctatatcattcacgctaaatcatggggcaggatgattttccgttaaagctgaataccagggaaggctttttaaaatttcaaatgcttgtgcttctgaacatcaagaggcaatctgtgaagagattcaaagcaagaaagaagacaggaaacataagaacaaagcttcttgtttccccatcaccaagtctagttaaaattttccagttgaagggagaccaaggaactaagatgagataagatgttcatggggctgagggacaatgtgctgcagacttgaaggaaccatgcagaatgaaggtaagtcatcatccagggaacagccagcccccactggagtggcactttatactgtcagcccatgggaacaccacggatactaagtcagaaactctaaaacttctggatccattcaagtgagaatcatgtcgcttgtgccaaagaatgacatcaatagtctttcatactagcaactggtaagaagcgcccatccatagcagcctactgcctacttaatgttaatcagtactggctccagtggcccaagataattttctcaggccttgactgttatgaattaacctaactcaattttgccagtcaaaattatcagattcatttggttatcagtagtttcaaatgcttagaagcagactaaggatacaagactcctcccaaaaacctccccagcaggcttcactgaaaacaatctcagattgcaaagaaaggagtcacacaactgagacagagcagggacccctcttaaaggcctgcagcccacccctcaccaccaaagcgtgataataagggaatattttgacttcctttaagggaaattccatacacctagttagccctgggaagtaaatgagcgatttgataagcaagaagacaaaagtagcttaaaacaatagctaaagcagttagcatcacaagatgttttgttccctatagaaattaaagataacattttaacctctcttcctgagttggtttacagaaatccaaactcccaccaaacggatccattggcacatagaactcagataaggggcaattgaggactgaactccgatcaccattcttcgttctaaatttcttcccgagggaggcagttaaacccatgagctaaagctaacattcttttctgctgatcccaaattttagacaaagctttgcttcttaaccaatcacaattcagaaagtctttgaatctacctatgacctagaggccctgcttcaagatgtcccacatttttagtcaaaccaatgtatagcctcaatgtattgatttatgactttttctgtaacctctgcctccccatctttataaactcctacctttaaaccatctcagagttcaggtcttaaacatgagctgcctgaatcttcttgctcagtaccctacaataaatacctcattttctctcatctccatcccagtgtcactctttggctttgctgcactggattagcagaccccggtttggttttgttgggtacaggcccccaaatctggccataaactggccccaaaactggccataaacaaaatctctgcagcactgtgatatgctcgtgatggccttgacgcccatgctggaaggttgtcggtttactggaataaaggtaaggaacacgtggcccacccagggaggaaaaccgcttaaggcgttcttaaaccacaaacaatagcatgagtgatctgtgccttaaggacatgttcatgctgcaggtaactagccagagcccatccttttattcagcccatccctttatttcccataaggaatacctttagtaaatcttattatgactggcttgctgtcaataaatatgtgggtaaatctctgttcggggctctcagctccgaaggctgtgagagtccctgatttcccactcgacactctatatttctgtgtgtgtgtctttaattcctgtagcattgctgggttagggcctccccaattgagctggtcttggcaggtttgataatacaacctttaccacaacctcaaggaagttccaagtctctctctttaggtaccatcaccagacctcacacctgagacaagagcaacaatattctaaagttaggaggcagcaactttacagttggtgttcaacaaccagaatttagtaaattagtacctggacattgtttcagaaacaagcttcaaatgccattgtaaaagatctggatgtctgagctagctggattctattcacctgaagatggaagggatcttcacaatatttttagtccatccacatattgctatagtttggatttttgtcccccaaaccttatgataaaatttgatccccaatgtcagaggtggggcctaatggaagtgtttggatgatgggggcagacctgtcattaatggcttggtgccatcttcatgataatgagtgatttattactctattagttccagtagggagctggttgtttattttaaaaaaagggatggaaatgcccctctcacttgcttcctctcttaccttgtgatctctgcacatgccagcttgccttcaccttctgccatgggtagaagtagcctgaggcttcacaagaagcaaatactggcactatccttcttgtacagcctgcagaactgtgagccaaataaacctcttttctttataaattacccattctcaggtactcctttataacaacactaacgtggactaagacatacaccttgaacaccagtaatttcaacaatgagcacttatttgcatatccatcatgataattgacaaaacctccactattgatatataaaggtaggtgaaatgcttgtagttacagtctctgaagtgtgacttttaatatactaactcaccatccatagagtaatttttgagattgggcagccatgcatcctagtaatgtgcattaaagccatcatacacacacatatatatcaaatgcatgtgctatactatttgaaagtaagttatagactataatttattaactgaggtcctgtgtgggtaacctgcttttcagtttcccagagcactcagaagcccttcaagttagagggtggagcactggatatctagaaggataatggtgatgatatttaggtgaaatcttcccaggtcctcaaacttcacagttgaacatgttgggaactgaatgcaatcagaagaaaatctcctccaaaaccaggaaagaagtatattatcttccattctttctggtcagggaacagaccctacatttgggacagagctcgatttgttggaatattttttcactatagctcccctatggactacgctgagtcatgctttctgcaacaaatgtctccattgttggcacaatggtccaagaaaaagctgttaatgtggccataccttgtggttttgttttatgagacacgtaatcgtgttaatttgttttatgagacaggtaattgtgttaatatacagatattgtgttagaaaattaaaccattcatatacaagtattgtaagaaattaaactatttatgttatatattttcactaattgatgttaaatgtggtttcttaaaatgttaatatgaaattaataacttaaatatagaacattcaaaattttataaggcaacaatatagaagtgattaagtaaaaagattatatgtcttacatatgcatctgttggggctcagaaaatgatatcccccaaattaaagtatcagaagcagtctcagaatcaaagtttctctctgaccttctgccttcctatctctcagcctcattctcttccaagacaaatcatagaaaccagaatctcttttccccaaagtcagctatgaagtttaaaattgttactctaactctccccacccacttccttccatgtaggaaatggccataaagaaggtgtttcatctaccttgtttgattatgagtcataacacccctattccagaattctgccctatgacagaaggaaatgaatttcctccaatcagtctattactattagatcatacattttattggccaatcacatttctactcagctgtccctgcttcacagaagctaaatataaaataagatagttttccctgtgtattagtcaggattctccagaggaacagaactaataggatatatgtacatgggaaagggagtttattaatgagaattgactcacaccatcacaaggtgaagtctcatgataggtcatctgcaagctgaggagaaagaaagccagtagtggcttagtccaagtcccaaagcctaaacagtagggaagtcgacatgacaatgcaaccttcagtctgtggccgaaggcctgagagcccctggcaaaccactggtgtaagtccaaaggccaaagaacctggagactgatgttcaagggtaggaagcatccagcacaggagaaaaatgaaagctggaagactcagcaagccagcttattccactctcttccacctgctttttctagccacactggcggccagttggatggtgcccacctacataaagggtgggtcttcctctcctagtccactaattcaaatgttaatctcctctggcaacaccctcacagacaaacccagaaacaatactttgcgtccttcaatccaatcaagctgacacttaatattaaccattataccctatatcatttggtcatttaacctggagcctcctgtgtcatgtaaaacttagattaaataaatctgttatgcttttctcttgttaacttgtcctttgtaataggggtgttggctattacttttaacatcctcaggaaatgcatcacacctttctgttcctacatatctatgcttgttattttatcgtttctgtatttctgtgtgctagattgcttcccatttccctttttccaccatcgtgaataatgctgcaattaatattttcatataagtttgctatgttttatttttccttaagatatactataagagattatgagtatttttatgatacttacggtctctggccaaattatttctcaaaagtgttgtatccattttgattcccaccaacaacacgtaagacaagacatatatttcacagaacattcactagctttacatattagcatttttaaattgtaatagtccacaattatgcctcactaatgttattatttgtatctcttttattcatagaaggttgagttttttcatatacttgtttagaaattatatttctgggctgggaattatatgtaatttcctgtaggagagaacaggtagtaccttattgtcacccattgcaagattactggctaagatccctatagcaaaaaagcagattaacaagagaaaagcataacatttttatttagtataagttttacatgacacaagagccttcacaaatgaagacgtaaaaacccacagaaatctatgtatttttgtagaaagttgtgcagaagcgtggctggaggacaaaggagtgtgatctaatggtaataaacaggggagaactcagccagacctgtttgtttagagtcttactggcttcccggtatagggcagggcccctctggaataaaagtcttatgtcctactttcaagggaggtagtgtagggaattcttttacggcctgcttcagaggagaaaggcaagagaagatcagcgaggaccttcctgtttctgcggagcgtttttgtcaatttccttcagcttaaaacactcatcatgccaaggtgacatattgccaatgggtattgtgttctgagccctgacaatcctttatatatttgtctatgacactgaagtgattttatgaattataatatttgccagaaataatttcccactgtataggggaaaaatttattttacccatcactagcttcactgctgaagtctctgtaacaacagacagattgacaagaaaaacgcatgcaaatttattcacttataaattttttgtgacatgggagtcttcagaaaggaggacctaaagaaacagggaaacctatgtattttcatgcttaagtttgacgaagagtggacagttctgcaaatgtatgactgcacaaagaagacataatcttacggtaataaactgcggggaacaaagcaaggcctgtttgttcagattcttctctctccctgtgtcttcagagataaggatgttccttcctctgggcataggaagggtacctctctgagggtcttacgacccacttcaggggagaagggcgagcgaaagttgagaggggccttcctggttcttctgttttctcaaatgtcaaggtgacatattttgagggtagcatgtattaaaccctatcaccagactttcatttgctttttaattttcttaatgtgtacttaaaacatttaaactgaaaaatattcgtggagtataatcgctcactctatttccttatgaattctcctgttgcattcatatttagaagaaaagtgtctgtccaaagatccagtaaacatccacctctattttcttaaagattttctatggcattattttaaaacaattaattgcttattctctctagaatttattcaggtgcatagtgtgggcttgatggaagattatttatgttttctaattgctaaacagatgcccccaacatcatttaatgtggagtaagaatgaggaagtttcatttgttgtcaatttgtgctacttccttaaagatgcagtacatttgtccttgcaatggaaacttcttctggactattttgctccataattcagatttcagtacaagtctgctgtagataatattacttctaattaatgtttgtatattttaattccagaacaacagaaaaattatggctgttaatgtttttgtgtttgtttttcttatgcttcttttttatctaatcataaattattttattagaaaaaaattaaaaagtcatcacatactcaggcctatagcatgtattcagagttaataaaggtattttgtcatgtttgattcagaacttagcctttcatttgaaaagtaacaaaacattacaaatacacgaacatctaagtaactgtctttacttcctagtcctgtctctattgaccctccaagagtccagttctctttggcttaaatgtggatctttcctatcgatatatgtgtctaaaatctagagtgttacttcctgtacatgttctgtttaatttatgtaaatggcattttgtatatattgctctacaacttttttaaaatttaagattacacttttgagagctatctatgttgatcaatatcagtctaatttattcattttaactgctgtgtagcgttatcacacgaatataacaaaatttctttacttgccttactcaaagacattgggttatttccaatgctttttataattacaaagtgctgagtagacagacttgatctattttactagaagaggaactatcaaggttaattaactgaaacaaaacaatttagattataaaattcactgaaaagtaaagattgaacataattagtgaagaaacagatagtataaagagtagaagacagtgtaattgtaacctcaaaaagggagatacatctgtcagtttaagctctaacaaaatatgtctagaatctgtatgctgaaagctataataaactaatgaaaaaagaaagataaacataaaagaaatgctaaactctaatcatatatctctagcaagaatattctaaaatttatgtagagatgcaaaggaaatagactagcccaaacaattctgaaaaagaaataagttggagggttcatactatctgatttttaaaaaatacctatacagttacagtcctctgaataaggaacccagaaatagactacacaaatacagtaacttattttttaataattttcagagaaatctaaataaaagaaatggaaaaaaaatctcttaccaatccataaaatctctcccttcacaaaggtagaagagaggccgggtgcagtggctcacacttgtaatctcagcacattgggaggccaaggtgggcagatcacttgaggcaggagtttgagaccagcctggccaacatggagaaatccgatctctactaaaaatacaaaaattaactaggtttggtggcgcatgcctgtaaccccagctacttgggaagctgaggcatgagaataacttgaacccaggaggtggaggttgcagtgagctaagatcgtgccactgcactcatgcctgggcaacagagtgagtgagactccatctcaaatgaaacaaaacaaaaaacaaaggtagaagaaaaaaaaacaattttattattccataagcattaaactataatgtaaggagcatcacatgcaactggctaaggggattgtaaaaatggaaagaaatcacaccattttgtatagcaaagcagatgcaatccattacatacatgtgaattgtctttatcaaaaataataataaaacttcttatatttttgtgaaaagcaggaagttacactaggagtcaagcacgtaggctgaaactcccacaggaacaggaagacagagctcatcttcctcgatgtttgcgtttcaaaaagaaggtccaaacatccccaagaaaaaaaaataactgaaatgaaaaactagcaagagactcatttagcttttaaagagatttaaatacgtctcaacctgacacataaaacatttgcaatctattttctaaaggaagtgcctatcagaaagaaagggggaaatgtttcctctctcttttggcatgagaaaaattacatttttaggatttatatttatactttatacaatatacaaagacagctgagtggataaagaatagtcctttctaaatagtggaaaaattacgtgtcatatacaaaatatatgaacctcaacatataccacacaccttatacaaaaatgaactcaaatggtttataaaaataaatgaaaaagtgtaaaattataaaacttatagaagaaaatacaggagaaaatccatgtgattttgaggttagaaatgagttttttttaagatatgataccaaaatagaaaattaatacatttcagttgattaaaatttaaactttcattttgtgaaagacactaataagaagacaaaaggtaaatcacaggttgggaggaaatatttgtaaatcatataccaatagaggacttttatccagaatatataaagaacatttaaagcttaatatgaagaaaacaaaaacattaaaaaaaggggcaaaaaactgaacaagaactttatcaaataaaatatacaatggtaaataagtatattaaaagcatctcaacattatcagtcattacagaaatgcaaattaaaactacaagaaggcataggattctgcaaagatggtggagtatgtagcatcaaaatctgactcctcaaaagtcaacaattgcactggcagaatttgtctgatgtaactattttggaattctgaagtctattgaaggcttgcaactttcaagggaaagcttagatggcaaattgctgttattttagtcaatttcagctcttaaaatagtagtagctacctatgctctataccaggggtccctaacccctgggccacagacctgtactggtccatggcctgttaggaactgggcagcacagcaggaggtgagtgacaggtgagcaagcattaccgcctgagctccgcctcctgtcatgtcagtggcggcattagattctcacaggagcatgaaccctattgtgaactgtacatgtgagtgatcttgctatcattctccttatgagaatctaactcatgcctgatgatctgaggtggaagagttacatcctgaaactatccccaataccaggtccgtggaaaaattgtctttcacaaaactggttcctcatgccaaaatggttgggaaaccctgctttacacctcagccacatggcaggctattttgcacatgttcctggagcaacttgcacacagcttgtaggacccagggtggacaaaattaattctactctttaaatagtggagatccgtgcttagttgctgattgccacttctgatcacaggggtgcagacacagaggtgatagcattgttgttgtaccttccccaattgtgcaagcctcttctccagctgaagtgacttccaggagatgtataaagctggtgtcccctccccttcatttttatttttttccttttttggaaaccagatattaaagactatggcattcaaaagcaaacacatatatgaaagaaattagaaaatcactatatatgcccagggaaacacagaagttcagaaaagatctgagaagactttaagttcacattggaggttgacctttggcaaagatacagtctatagcaaaaatgacaactaaaaaaaccataataacaaaaatacttaaatcccagggaaagaagaaaatctgatttccagagttagcatgttattacttacaaatggccaattttcaaccacaacaaaaaattataagacaaataaagaaataggaaataacggctcactcaaagaaaaaaaaccacagtaaaaaccatacctcaaaatggatctactagacaaagactttaaaacaactatgttaaagatattcaaagaactaaaggacgatgtgtagaaagtcaacaaaatgttctatgaacaaaatggaaatagcaataaagacatgtaaaacctaaaaagaaagaaacaaacaaaaaccaaaattctggagccaaaagtttcaataactgaaatgagaaatccattacagatactcaaaggtttgagcaagcagaagaaagaatcagcgaacttgaagataagacaatggaaattattaacacaagaaatagaaagaaaaaagattaaagaaaagtgaactggcttttgggacaccatcaagtgaatcaatgtacacattgtgaaagtcctagaaggagaagagagagaaaaatagactatttaaagaaataatgagttaaaactttctaaatttgatcaatgatataaatataaacctctaaggtgagggcatgtcaaaaggacacagaagtcaatctgtgaaagctcccagtgatcaaacctggaaccacctgagcataaaatgaatatcctcgagtccacactgatataagtacaaaattaaatacataaataactatggagaaatgcatgtttttcttacaaaataattccaattgataaatgtaaaagagatgacagaaatacaaagtggggccaggtgcggtggctgatgcctgtaatcccagcgctttgggaggccgaggcgggtggatcatgaggtcaggacttcaagaccagcctggccaacatggtgaaaccccgtctctactaaaaatacaaaaattatctgggcatggtggtgtgtgcctgtaatcccagctactcagggggctgaggcaggagaattgcttgaactgggacctgggaggaggaggttgccataagccgagatcctgccactgcactccagcctgggctacagagtgagattccgtctcaaaaaacaaacaaacaaaagttagcagtagaacaccacaggaataattgcagctggcagcatccactgatgactgcaaaaattagtgagcaaaactgtaaggagaaataggatacttgcatagccttaaaaatctcccctaaaatatttattaattattgttagtggttttactttatgtctacagattcttttatactcctcactccaaaaatggagcttaattctcctccataagtaactcacttataaataatagtgcatgaaaagggaaaaacagtaaacttcacaatggagaaacctgccaggtactaccttaaccaagtgatcaacattaacatcatcagtaataagaccagacacaacccagacatcttagtctaaggctaattttgtcctactattgaggcaaggctttttaaagtattctacccaatgcttttctaagtattctacccaatgtcttgtaaatcatgaggtttttcagcctggctagtagaaggaggcaatattacaggccctgtatgagaactggacactgtttccttaaaccttctaagggaattctttcttcagcctcaggtagttttcttacatgcatgtgctgatcagtactctgttgaagactcaagggagactctctgcggatcagaattttctctcaatgtagctcttttctcttcagtaatctgtcccaatcctctagctacctggtctcccagtgtttcaaatccgtctctttaactcaaagagtcttctgagatccatcttggcttctcttcctgtgccacacttaaaaaacaaacaaaaaacacctctcattcattaagctggagcaatcattgggttcacctcattagcttcctatttctcagggatcactgtccttcattacctgatgtccaatgtcttaaaaacttatttaatatattttgccctgttgttttgttgtttcatgtgaaagaataaatttggttcctgctactccatcttgtagaaatggaacactttctttaaatactttaattctagcttttacatctattattttatcacccaatccttttatctctctgttcatttattttacttctgacagttttctcaagtcaatcttgtgcttaattcatctaaacatcaaattattttatatttattcatttattatctatatatccaacaatcattgctaatatctgctgtttccagtgcagagttgaattacagaagcacaaaattatatgcaggatacataagtgattgaattaataaaataatacttctcaggattatttaagaaagaatatttgggtaaacgtaaagcactataacatgtttaaaaaataactgtttatattttctacccacaactaaatcttaccccctttaatctctctctctctttttctgactctgtgaggtcagtttattactcccttttctcccaatatgctatggatgttttccatttctttcctggtgattcaggtttgtcctttaagttcgtgagaagcccacagcagcttaaattggttgagtttgatgctctacttcaccactgtaacttactcaggtcaactctctaccaggaagcaaactgatatctaatctttgtgaaacctaaaatatgcttgactcttgtgatccggaataactgtggctaagtattttttcctcgttttcagcatttaatggctgttttggtgaaaaagagagaaaagggatttcatgggcaattactcttcaaattaagaaaaatcatctgtaagcaatgaaactcacaatggggtccaaagtcacccaaacatgcagctagtgctcttaattcagcaaactctttgaagaatattcattggattttttattttgaagataagaaccaaaggcaacccatttagagcatcaggcctaagactttaagacatttagttatgattacagaaagcagcatcacagaacattcagcaaccacgggatttgagagctgcagcagcagcagcataaatgccaaccattgacttctaattaccaggcgcttcttagaagacggcagttggcacagtggctggtgatccagtttttcttcggttttcatatgcagtagtaagttatgattgtcagtgtgtttcagttttctgaattctatcatatctctttttggaagttacttgctcatccaaattcattcaccacttgcctacttaactaagcttccttccaaatttctctggtaatgacaatccttttttccacttacccatagtcaaagacttgcatcaatattccacaaatgcccttactcataatagtgcacccttactattggtcctttagaatagtgtgatccacacacatcacgtatattaaactgctgacctgtgaaggggaagcttaaacactggctgtagtgttcaggtcaatgaccttggtaccaatttgatctctttcggaagttatgtatttgtagctctaccaggctctgttaactcttgctttactctccatctttggaaattggattttattgtttaggcttggcctatgcagcattcaatctactcttttcccaagatgtaaagtatagtggtggtcactgcatttcagttaaaaatcttatacttcctttttggctttggagaacccagacctgctgccaacacttgacaaacatcctgaccaagtcagccccatccctaaaagtaccatgccttcaacctataatccagtccctgatctgtaactacatacatacaccataggccaggagaagagctgttgtgtgaaacctatatctattaagatgtttccatgatcttaaaactcagaccaatagagattggaaacactatgctagagcataaatatgcaggattaatcacgtgactgttatttcactgatttagctagctatagtaggggtggaacaggcctgggtgccacacaattagtttattcataatctctaggatctgttcttcacccttgtttgttcacattaggagaagagatgcagaaattctcacctataccttattcagctacaactacatatggatatcctgagcttgcagagagtaaagatttttaacatttcctcacaatttgcataccagattagggcgatatgcaaaccagcaagtcactataacatgaatgtaaaagccccccagaagccattcaggttggattgcatagctctgccctcaaagatgtgagaataccaaaactgattcacaggctccagacaacggacagtaaaacactgatttggggatattcgtcccagaatgagaaaattctctcctatagatccaaattagaggccttagaggggtttttgaacacttgatctagtcattcaactaaaaattcaacccacatgttaacttagatatgagatgaaagacatatttttctatttagcatgggttcttaaatgcgtcccaagagaggggagttgagataatgacatttgctcaagcatccattgctcatccttttctgtacccagcccatcagcagaaaggaaccacacctgcagagagaacagctgtgtttccattacggtttaacaatcttctcatcccttcatttccggcagagcatgacttacccagagaaacttcaaagctttcaaataacagaataaaaattgtttaggactcaccatccacatgaaccatagtttgaactatttgtgtactacattgttatcagttagaatttcaaattccagaatatttcaaatgtgagtctatatggtgtcagtgaggtgttaaccgacccatctatgatttgcgaagtcttaagatggatgaactcttgtcatactctatcgtgaggaaatatttacaactcaaaatcatgcttaagaagaaaaattttctgagataagtcaagtctagccaggtgcagtggctcacgcctgtaatctcagcactttgggaggacaaggcaggtggatcacaaggtcaggagatcgagaccatcctggctaacacggtgaaaccccatctctactaaaaatacaaaaaaattagccgggtgtggtggcgggtgcctgtagtcctagctacatgggaggctgaggcaggagaatggtgtgaacctgggaggcggagcttgcagtgagccaatattgcgccactgcacctcagcctgggtgacagataagtcaagtctaaatttatttttaagaagaaacttttctcttttcctgtaggggcacatttactaaccagaacacattatgtctcaatttgtagcatgtgttttaaaattagaggtgactttagcactttctctaaggcaattggttagttgttttacatttatgatatgccgctcaaattaaaaagtcatctccaaatacaaaagcacccatctgccaatcttccttacttccctaattatatattgagcaattaattaccatgtgtcaagccctctataaatattatagtttaattttttaaaatgcacagagatatgtaattacaaatagtcacacctatattttagggaaagtacagcagcttatattggtgcgatgccatttgcgtgggtagagggtaggcagagaagccatccttaaagaactgagaatcaagctgagatctgaactgtaagcacaaatttagttaggcgtagagagagaagaaggaaatcgcacttgaggcaaagggagtacatgcaacatccaaaggttttgacattcaggggaaagaagaggggaggctgaaagaagactgaattttctggaccccagcatgagaaaggcaccaaaacataaagctgaaacttcatggaacctggaggcatgcagagctttggcagccacttgcagaattagatccttatgagaattcaaatcacttccttccatatagcttaactatcaggaatgagaatgaggatcacttacaccaacaagatttaactgtttattcttaactggagattcttgctcagaaagttaaggctgtaagtcaatgaataactttattgtttactttaggaaattcctgctaaccgatttatccaaacaaacacttgactcatctctcccatcaggacaaaagaatgttcacctgcagaaacagcttgcttatcaaacagcagtttatttgtcaagactcacatcaagactttcactttgctgtgctcaccagtcctaaacaattacatgataaattgtattccagtcagtttgtcttctaagctactcgtgttcaagaccaaagcctataaacatcctcctcttccccctttctgggacaccactaaaactcattcaaggccataggataaatagacttaggtttttttcactaacaagttttctggtagtctttggcagagttggtagttgtcaatcctgggagcaaacaaaaagcgattgaggatttttaagaaaagtggaagataggaccagcattttaatttggttgcagtttggtgagcagattggacaaagcacagaatcaatgtacagatgtggcagtaaggaggctattgctatagtccaggagaaacgtgacagaagcttggaatttgaacatgacaattgagataggataaatggatggattagagatgtgttttgaaggtagatccaacaagccctgctaatagtggaggacagggggagttagaggtgttaagcattaatttatgaatttttggtttgccgaactagatagaaaatggtgccacttattgagatggaaaacatagaaaaggagcaggtttggagaggaatgtgaggttgggggtaggaaatcatgagtcagttttggacatgctgagtttgagttgtctttgagatactcaagtggcaatgtcaagtaagcatttggacgtgtggtcatggagatcagaaaaggtctgagaaacaaagcaatggccaaatactcagaaaataattatttcatctccactgtgtttcccgtttaaatttcgtagtatatgcactcaaagggccctttatactgctatcctccaacttcagtggcaaaaagcagaaaggaaaattcttgtattcaggcttgagaaagatggcagggtggtatgatgtaattattgccttctaagagcaacttggttcttaatggccttttctttccatatagctatactaacaagaagttaagagcctgggctctggggtgaagcggacttagatttgactcttgaatctataacttactagatcgataatcttaagagattttcttaaactgagcctcaggttcctcaattataagttgaggataataataactaccacctcatagggtattatgagaagcaaataagtccatgtagtgtggctggcatagtacttggtgtgtagtatggactcaataaatgttagtttttgctataattatccttggattccggcattagaggattctcaagcttatagaattttggccataagaaatgccatgcctgcaaaattagagagttaaggaaacagaaaacttatactattttctaatgtacttcatgcccacacccaaactcaccgccaaccccatggaactataagggtctaagtatccagtgcttcatttgactaatctcatgcccgttgagaagaagtggaaaacagaatgaagactgagagctctcatttttcttcccttgtgacttacatttaacctggggttgtttttgtatcactagatgagttttccctgaaaagctagtcaagagtccctttattgcactgttgctactgaactgtggtccctaaagccaagagattcatgaaaagggaacttctttctgaatccagttggattgagcaatttaatccatattttcttgagttacattgtgtaaaataaatcctatacaaatttgaacaatcatacaagttctacttagttgaaataaatttgcccaaggtcaatctagctcaaatagaatgtgatcaaaacagagagacataaaattacttcaaactgcaatcaggccagttcaaattatgttaggctacttcagaccagtttaaattaaaaggaatcaaactggtcctgaagagcttaaattgagtcaaatttttttccagttcaaaattggctctaattgagtcaaggggattaagacatttcaagttgtatcaatccatttctagttggattagataagcatgaaccaggcaagctggctctgatcagctagaatgagacaaattgaattctaaacagtttaattggaatcaagctttatcaatctaagttaatttctgtgctgcctgggaaacaaaacattgctttaagaactggtgtcactccatgcttgtgtcatggtggcaaaaacgatgagttgcttgccagtgtccattctcatagttttcttcactactagtggaactacttatgtggttgtggtcatcaatgtgtctagctaaaacaaagcaaaaaacaaacaaaaacctacattttctcatctctcctgaagagaaatatggcaaatggagtgggcattgaaaaataagttcttttctatttcttgtgcctgaattgtggaaaaaaatggctggaactacagagttgcaaccatgggtaaaacatggtgacttaattcatctctaaggatggcacaataaaaatatataaggatcctgggtaacatggtaaaggtaccatctcctgtttccaaagtggtcagtgctccttccaaatctcctaggcactcaccagtcctgctgaagactttaccttcaagcatctgtactctctgtccaaaggattactagggccatagggggagcatggtgggggactgtcagggagctaatgcccctgggatcagtttcaaccaatttatcaaccaatggattaacacctgttcttccccagccctcagatgggacatctccaaggtatattttataccctttcgccgatgtcatgggtaggatcaagcctcagttgctcagagcattaatttgctcactaataatcactactgattctcttccctttcctgtctcactgtaccactcccaaaacagtgtttcctggcatcaccaaatgaataggatacttgctctcaaatccttgtctcatgcctgcctatgaggtaaccaaatataagaccatctctggattgtctatcttggaacttcttttgaataaagaaacataagcctctttaatcaaatcacaattatttgagtattctgtaatatgctgctaaaccctttcttatctgatctgattagcaatgtaataatttcttaagcttaaatctctttattattagtagtcctttttccaatgaagaaaaactattaaaaaccaaaagccagaagaagaatttaaaagccttttgatttaataaaatctgatgcctactaaaataaatattgaaaattatattctaaatgtttacttttagcaaatacaatttcaacaagtaaatggctttacattgccaactagtaaatttcagttcttacttgactcatccatagcttttgatagagttggtcctttcctcctttctgaaaaatgtttctctaattggtctgtaggcaaccaccctctcttggctttccttctgcctcactggctgcttctttccagtctcctttgctggtttcccctcatctcaagctggtattcttaggctcaatctttggcctgtgtctcctttttatcaacaagcatgctctacatgatatcatttgatcccataatttgaaatagtatccctaggttgatagatcttaaatttacatcttcaatcccaatttctcccctgaagttgagactcataattattacttatataccatctgtggttggctggtttttagacagctcagtttttacatggctgaaaccaggcaaaaccactgttcctgcaatcttcaactcagtaaatggcaactcctttataatggttgcccgggccaaaagcatacgaaactagccacaattcctcatttcgctttcaacactccacaccagtagccaaccctatcaactccacctttaaatgcttccagaatctgaccccttttcaccatacctccactaaaatggtaatataaactaccacaatttcttgcttgaactctttcaattgcttcctattttagttctctgagtctactcttgccccacgcacacccaattctctaagcagtaatcagtgtgatcttgattcaaatataaatggaattacatcaataccctgtccaaattttccagtgtatatccatctaactctaagtcttcacctacagaacccagtgtagctcactcccagacacttttttacttcatcattcaccactcactctgtcattcacttggcttcagccagactcacctccatgttgatccttggacacataccatgaatccaactcctcaggcgtctgacttatcataccctctatctagaagatcttctaatcagctacccttgtgcctctctccctcacttcctggaagtctccattcaaatattacctcaacagaggccatgactaaccaacttttctaccatagcacggcccaccacactctcccttccatgctctatctttttactctgtttttcttcagaatatttattgccacctgacatgttatatatttatgtgtcatctgtctccattaggatgaaaatgttagaagagaaaggactttgtctattttattccctgaatatttctagtacctagataattgcctagaacatagcaggcacactataaatgttttaatgaaagaataaatgcattataatcatacttttatcaaaaaattatttttgaccacttagtcaaatacctgattgagtgtggtatgtctgaatatttcaagaaaaaataatgaaattttcaaaatttctggcagcagttttttttttacattgatcaaggagctgccctctctcgtaaaaaggcacagcaggagttgaactgtggctgagatacccatggcttacccagtaattgagaaagactaaacaagagagtccactctttgctataactgctttttccattttattcaaggtgttaactaaaatacagagagctttcaacctactttttcagtcattaaactaaaatgccaaccaagtccagttcacttctaaaatgtattggtacaatccagtaaagaggagatgacaggaaaagaaaagtcaacaacactaagtatagtaatgttcctttttgtttcatgaaacccaaattgttacaaacatcaattttagaaatattttatgtagacattaaaacaaaaaggcaacaagaaatgcaaaataaacacacacacacacacacacacaccaataggtttcacctgagaatttgaagtaattcagagacagatttaatattctttgaccaatagagataccgagaaactgtgcacactaaaatgaaaataagcaataaaagcaaatagtactcaaaatttaaatgacattggttaacaatggagtacgaaaaggttattgaatgtgctaagtctaatgctttaacactcttcaatcattcaccttttaatgcagacctttaattatattcataatcttatcttggtgaactctacacccacacctatgaattctgtcaatttcttagttaaacaaaactctcctagaaacctaggaccagggtcagagatagaattaaaatcacccactctcaggagaaatggaggaagcatttacactgaaagtctgctgaatcccagattctgtaatataaaccacttaataatctatactgacatttcaaagcttaggaaagggaatgttgtacaaccctggacttcattgtgtttattccctatgaggcacagagcaagataataaacaagcccctcaagctaaaagaggaacacagaaacatatatgtgtgtatatatatatatactatacacacacatatgtatgtgtgtgtatatatatacatatatatgtatatatgtatatcacagaaacatatatatttcccaaatttttcttaaaaagcaccccagttcaggtatcttgaataaagaaaattagtcatagacgaaaaaaaagaaaaccttccagttgtctaccaagaaaaaactaatatggatattacatgcatttctattttgaagaccaacagtttattaatttattaatagaacctgtatttttctgtcaattattgtgctttcaattattgtgctttgaattatatatatatatatatgtgtgtgtgtgtatatatatatatatatataattttaacttttgagaatggataattttaacttttgagataaacattcagcctgcataaaacataaatctctatgaagtaaacatcttatacagtttctctctttaaaaatagctttgacatgcttctgatgtccttaaatatttgtgctgcagatgccatagttgtattttttcaaagactggctcagaggcttctgaaatattagatatccctttgctggcaaaacatcagagtgggtattcgatcattacaaggtttttcttaaaccagtgtttctcggattttactgtgcatcagaattccctgacgggcttgttaaaacacagaatactgggcctcacccccagagcttctgatccagttggtctagagaaagcctgagaatctgcatttttagcaagttcccaggtgatgctttgatgctgatagtccagggaccacactttgagaaccactgctttaaaccgttagtttataagttctttaaagagcaatgtaagcttagaatccagaacctacatggtacttactaaactctcttcagagctgtgttccaggggcattccttgagaaaatcatttttttttttaaactttcttcttttagcaacagtaatgcccaggcagctagagagtccttaatattcattgcttagcattttggttttgctgggcctggactgggagtattccctatttctcatcagaagggctgcaatctactgtgtatctccaagatgttctggatctaaactctcccaggataggatctatgcctctgggggaccaaagccacagctacatgtctttacccagtaagtctatctcatccaggaggaagtccatgtcctcccggctcacttgagggctgatcaccacctggcggaagaagttgacctttccccggtgcggctggtagcccagcatcaagcttcccttcttcatcatcctctccttaatggctggggccacctgtgtggggagaaaaggggagaggggtgaaagaccagaacatcaaggcatttcaatagcattttcaccagccattggacatttactgggcatccactggtttggatcccattctcattcacacaaggttgacactaataataataataatttatggaggactcatgagtactgattcaagtgctttagacatattaattaatcttcacaataacagtgaggaagatgctactaatgtgcccatttatggtcgagaaaacaggtacatggcgagtaaatcagtatctcaaggtcccaggcattttctccctaagcccatactcttaagtgtaaatcattattcaatgctgcctcattaaaaacaaatcaggtgtccacagggattacagtctcattctcaaatttgtcttaactaaaaaacaccccagttcaggtatcttgaataaagaaaattagtcatagatggaaaagaaggaaacccttccagttgtctaccaagaaaaaacaaatatggatattatgtacagttctattttgaagcctaagtttattaatttattaatagaacatgtatttttcatcctagaaaaaaagaaagttagatattattctcatatatgaaatataaacaccctgtctcttattaagagatgtaaatgtggtaataaaattaggaagcacatattttaaagatctatagctgacatgagaagtacaggccctgataatccagatacacagatttttctaaaagtttaatgtttgaagaaactagtctaatttaagaaccacatgggaaaatcagtccattttctaatcagtagtatggccaccaaagagctaggttgtaaacttttaaaatagtgaagttcatttttgatacactgagttaaaatattaagaatgcatttttactgtcttggaaatacaagcaaagtttttccacttgaattttattttaactctgaaaactttttgagtgtgtcctatgtgaatatgtggaaagggaatataatgagtttctatccttgccttctcaggaagatgagacttactcctccagaagggaggagtacatatagaaagaacaccaggcagagtgtgcttttaaactccttaggtgaggggcatgaatctgggttcccacgagtctccctctctcgtaatgtgataatcccacaccagcccagtttttgaacatacccacattttgtcagcaagtcaaatgacttcatctgacactcaacacaatcttgatctgttccaaagctgatgaaaaaattgggtgttttagacctctgaagatattatgtgttgaacttaaccacagagccttctcaaaggatgttcaaggttaattttaactcaacacttttttttccacatgtactaattttagaatataagtcttgcaaaacatggactacacagtgcttgcaataacaaaacaaacacctattcaggaaaatcacattgccattctagcaaaaaactggaagtttcttacattatcacaagatatgaaaagaaaatatatgagtgtaaaagaaaaaatgtagaaaaggtgatgttagaggtcaagttagtgaaaaaagcatgggccatcaggttctacaaacttctaaatatatgtgacacattttattctgagctttctagagattagaaaaatgtaactaaacaacagcctgcattcacttgaaaagagtggcaaatgtccagttgatgctggaagccagaagctaggaagtaactctctactatgcttatacatatctgcttcaaacccatgaatttgtatgcattggttgagttttcttccaaatccatgtatgcaagtagtaattctaaaatctagtaaaaaaatatgtaaaacaaagatagatgagtgccaaaaaaagtgatttttgtaaaaactaagttgagtcctttggaaagaagagataaagggggatggctaaacatcattgtgatcacactaggcaagagaactgtaaaagcttttgagaatccagactgattctgcacggagatcgctacacaggtgtctgagtacttacttcacctgaagaaacccgagctgcataagacagatgattcctgaagaatgtagtttatgcaagaacagtggagggccctctcatcatcagacctctacttaagaaaagtttcacttgtttataaaaagcatttggaaatcttcactaggtggaaaaaacctttccatcaaaagatggtaacataaatgtacactgatatacaaatataacattaaaaatttaaatataaagatacaaatattaaatgggaaaatgctcacattatgtatgtatcacattattttctagaattatttgctttacctgactaatcctcctcaccttaggtaggagggcttctcgtgcatatgtggatataaatgggtctgcgtgcataagcatgtgtgtgtgtgtgtgcctgtgcatatatgcacatgttaatatacacactcacatataatttaaacctctgacccaccatattgtactgcttttaaaatctctctggccacagggcaatggagaaccacgctttgacttaggttcatcataaaagtacacttgtttttaattcaaagaacaagtggctttctgaatgcaaactgtgagaaaaagacaacagtagtgccagtgctgaatcaagattgggaagacctggtttacatggaccaaatgtctagctagaagggccacagactatcagttttagagcttacagcttgcggttctgtggttcttgtttttgaaatcaaaattctcttcatgttcctctccttcgtcctccaggtacccagggtataactggctctggcttgtagccaattttaaatgtaaaacaggcatgctcttggctcaggcctaatttgcatagtgtattcctgtttacttttcaatacttccattttttctcccaaaatggtattttatgccttatctttggagagcattagaattttgattccagtacataatatatctgaggctcacatgaggcaattatcaaaatgaatctgtcacgtttgtatttcttgtgaggaagccagaaatactttctaacgtgaacaagaaaggtaaaggaagagggcacctcagatgttttaatataaagatactttggatgtttaaattcttgctcttgtgtaaagcgcatgactgtacttccatgggcaaaacgcagggaataaaaaccaaacttctaggacaaattttgttactgactttctgagattataaagacataactaaatatatgactcagagaactagctaagcaagggtttaacagtacaacacatttttatttatgagtctatgaactataagattaattcctacaggcagttactactaggtaaaaaaggaaggtctcccttgtctatgaatacttcgcgggaaagaaagtaataacatcaaagctgatattcatcaaatctttatcacaaactattctgctggtagtagtagttgttgtttttaacaagtattttaccagttctttacaatttgcaatgtcctctcacttgtctgattcccataaattcaaattaaagcttatttgaaaggaattcatgttttggcaatttagggaccaagcacgttctcactaacagtcagcttatcacctttgcacttaaaatcaaccattttttatttatgaagctccaggcataatccaatgctaggtaatttggatattcctttttgctgatcacagcagagacagtcctaatctgacaggatggcatggtcacaggggaaggaaaatatgcatgaactaaatgtaggtatccagataccacccctaaatggggcgcgcatagaggaaagcaatttggcaggagtgagattgctttccagctctcaattatttttctgctgttttttcttcaaattgtaaatcaaattcttttcttgtgcctcagtgcactggtccctgcatcttaagtggaggaagattctgacatttctatttggatacacggtgacttaatgtacacatttctgtggaatttgtctctccctacccctgagttatgttccatcagtgatttagtcatttaaatagagtctcgttgcacatcgctgtagcaccaaataggatttgatatttaaaagttgcttaaacccaaggaaaaataaaataaaatgactttctttctgaccaagcagggcaattcgataaaaagcttctgaccaggcatcattattgcctttgattaaaataaaatgataatttccataaaatgacatttctttttaagaatttgttatatactcagtgttaacaagaacagtttttcaaaatacaaagtgtttttcagggtcgggcatggttgctcacgcctgtaatctcagtactttgggacgccaaggcgggcagatcacttgaggccaggagtttgagaccagcctgagcaaaatggtgaaatctgtctctactaaaaatacaaaaattagctgggtgaggtgctgcttctttgtaatcccaactactagggaggctgcggcacgggacgcaggggttgtggtgagccaagatcactccactgcattccaacccgggtgatggagtgagactctgtcttaaaaaaaagtaataaaatacaaagtgtttttcaaactatctgtggggaaggatcagttttatttttttcaatgcattataaactaatactttagtaaaatacaataaaaatcaattactagcaaaatgaaataaaaatacaagcccaattttgtttatttttaagttcaatagtaaagctaatctgttaaggttgctataaaagtttctaaatggaaactgtggatttccataaatttcttattgcagactggtgacacagatgggttgggattgctgctgtggctttcttccagtatagtttttctggaacaatcacaaaaactaatttgctttatactttcctcccacgtaatctgggttcccaatgtgtcccactttctatgtcaacttgaggagagttctgctgagtgggatattgaaatctagttcatggaaaaaattggcatgaaatgttcatactttgtatctggcacccaaaactatcactgagacttacatacctccctcccctgtaaagtcatctcttttcttttcttttccttttctccttccttccttccttccttccttccttccttccttccttccttccttcctccttccctccctccctccttccctctctccctctcttgattgcttgcttgctttctcttctttctttctttttttgtagtttggggtcatcttagattttctgaagccaggtggagatacaccacggatcaaggcaggggccagaattcagggcatgaacagcatcaaggggagagcttaagtggaaggatttcagtccaagagaagtattaacatgtcaagacaattcagactttgatgggctttccccgtgcctcccccttctgagggggtgctccaatgcagtggctatctagaaggcagagtttttcctgtctcactgtactcaggagaaattagccacagtcctcaaaagctgaaggctgattaaccatctgagaaaagccaacctagagagtcttgaatgccagcttctgcagatgtgaaaagttagacatgtgagaaagcatgaaattcttttatttgctttattaatttttctggtatttatctccataactaaagcattatggttgccagtgaatttaaggtcttcagaaccatgttagatcacaaagtctcacatcgatttacatctctgtttgccttttagtttcaatttttgtttaagtatattcttcagtggaaagtggatttcatctgtttctggtgatgaaagagctcaacaatatgtctcatacaaatacttcttaaaacctaatgaatattcttatctctgaactacatatctgaccataaatatgaactgaattattctgcctgtaaatatgaactggattttcctttacacgtgcagctcacaacatgtagagctgaaatgggctttggattcagctaaatatatatcctctagtgtgtaacctccatgttagccaggcaggttgttactaaatgaacagctgttgacagaaagcatttccttatcgtccaaacatatgatagtgcaaaaaagaaagtggttgttttagtcttatataaaaaaatttttgtggtaatggttagctttacatctttaaaatgtattaaacggatagtttcaccaaataaaaaaaattgctaacccacaatatagaagcttttctttgtatttccaaatatgtctgagtaatttgtctcttctcccaaatgagacatcttacataccagacatttgccctcccaacacagcttgcttttgtccatagccataaactgcagaaattttgattatctttcatcatatagtcaattttgctccccattaaggaagaaaccagtacttgacagacaagtactttagcaccttcatgtttcttagagcacctgacaatgtaaagaggggaaaataatagccttcttagtttgtgttcaggtaccatctaaatctctctactttgttgttgttgtttttcttcctgatttagtcttaggtaaaatgatctgatttctctgttgtttcatcaagttacacattttccttctggaatagaaaaatagcaagggtgctgccctttttgaaagctacttgatccatgcagtaaagaaaactaaatctcccattgcattgtgtagaaggggtcacactatacaatttaaccttctacggcaattgtttgttaatgaaaaatttagaacatttttcttaaaaatgccaaatcgaatgaaatcattcactctattttcttcttcttctttacattggtgttttggctgtatagtcttcatgaaaaaagaaatgtgaatgtttacagcaactttattcaaagcaacacaaatgtacttcaagtacagaatggataaacaaaactgtggtatacctatacaatggaatactactcagcaattaaagggaataaactaccaacacaacatagaagaatctccaatagattatgctaacagaaagaagccagactcaaaggctgccttctatatgtttccatttatgtggcattctggaaatggcaaaatcaaatggctagagaagagatgagtggttgccaggacttgggctgaggggaagggttgactacaaagggtcagtcctagggaattttggtgagtgatgaacactgtgtcatggcggtgggtatataaacaccagcagacaataaattctgttcgaagctgggcctttgcactcttgggtgcaaaggaagaaggcattttgaacatggtggaacttgaagcttttcttcctggtgggctgagtggaataatgggaactgcatggctcaaagattttgggggctctaccacacatcagattgaacatatttaaatgtacccaacatacttattaaatataattcatatgcaatcatagaagatttcagttgaattgtgatggactaaattaacataatctttcattatgtttgtttttcagttttccttttacattttggatccatttttaaaactagcaagtattttaatgtggccctattgaattccatgctctcaatgtttattttgcctgatgattaaataaacaagctctgttcacactagtgtgatcaaatatctagtttgctcaggagacacccattttatacatgttttcctgtaattatcaataacaccccttttcatggccataagtgtcccagttcagatgataaactttatggattagaccgaccatacacagaccaacagactagcttagactgacttgtgacctaattcctgagattctctgtgactttgggccaatatttaactcctctgggaatcatatttctcttccattcagagccgataatcctttgcagggtccttatgtggactaaatgaaataatgagaacacaataagcatagtgcttggcatactaggcactcactaataggaactaatattatttatttcttaaaataaatttgtatttaatcaatttacactcccgcttggacttttattacattatttcattattatctcttgagacatgaacatttgcaagtgctatgaaaaacatgaaataatttattttctccccgaagtgtctaaactggatttaaatatttatgagacaggctgcaagtttgaagtttcagaaattaaatattgcaactcatgtatgccattaatcttccatttaagttccaggattttttcaaacgttgataaagtcaacttacatttttcctttacaaagtaacacagtcattgataatcttggcagattttttggagggaagttttccactaaaatttattgtgggcagggatgagtttttattatattctagaaatttctatctgttgcataagttgttagaatacaaaaacattttaaaagtaaaaaaagttactttttcttggacccatgaaaaggccatgtacttaaaattcatgagcttatttccagcattgtgcagtctccttgtgctttcttgtcacttatgtctttatcaaagaaaggttgaagaatactatttggtatgtcccaaacgtacaagaaaatacaaatcacctagattcaggccccaatcagagcagctgaatttgaatttcagtcgaataagcctagtggtctgtatatttaccaggccacccaaatgctctttttcatgatgtaagtttggtgaatgatgatctcttacttaggactttgggagaggcaaaggtgaggttggaggtaagaggagtttagtaaaggaaaagcaattttgacagaagaggggagaggaaattgagaatttcctctcgcattgcttatgtcgattttgtaataaaacaaaccagtgaccttcaaagaagttgttagccaacttttttgttaatcataaaatctaataaagtgtttaaaacacttaaccatggcccaggaaacaatgagcctcttagttttgattgctcaaagaatcaatttttctcttctaatatattttctgccatttttaaacctatctaattcttctcttactccttcatacaaccttactcatttcccctgatacctccccaatccataatttagaggtaaaatgcattagtatgagtctctcaagtttaaattatgtaaaattggtggtctatagcccatgaaatcatgtgcatccaagagatcattttagcttggcagaatatgaagaaaaaagccatactttgattggacatacctttttcaaatatgaattttacccttattttcctcctgagtatatctgaaaatcagacatgcgcaaaataaaagaactgcctcattcatgttctttccaatacagatgagcaaagctacagaaacaaagagtttagaaaccccaaaagccagaaaaacacagtgagcttcacatttggtgtttacaacatagtgacaatgatgacagcacttccaataaacctaatgtcagtcatatattcaaggcagctgaaatgaacagtcataaaaacaaacgaaactgaactgaaagctttagctgaacaatggacacaataaacattttatacactctataaagcaaaagcttaatacccagttgtgtctcagcagccacctgagctaatagctcctgagtaactgttgtgggccaactcccaaatgtctgcctatgttgggagatccctgtactgctccctaaatgcagttattcagtagctctctaccagaggtgctaccaactcccttggggcatttggaatcatggcaaagcattttggatggttgcaatgactgtggagtgctacttgcagttagtgtctcatggttaagggtgccaaacacctcacaatgctgaaaataaatctgcccaaggaagaatcatgttatccaaaatgccagtagtgcctctgttgagaaacacttctcaggagccccataattcccaccgacatctctacactttttcttgacatatcctgagacctttaagtttttctcgggagtcattaaccttgctttggcccagagcaaagtaaatgggatcttcagtgcttaaaggtatgttcatgttgttttccaaggattcataacatattcaatgagtatcactccatctgagaggagagaatgagtacaatcccaggttcttctttaggttctatgggcagtggtccaatatttctgaatattgtgtctggccatttcagcaggcatacgatgctttagtttcggcactactgcctattacaataagtgggtcatattcatgagtttttagccacacagatgtcacattcacaccttacccacacacttagtgagatgagaagcacctgaaatacactctatagaagatgaaaattatgattcattttctcacgggttttctcagggcaactttctctgagaattctattacttttcaatatttggcattgggaaattagcagctacaattttctcttttgatttattccactctaacaagccactgacagccaacgaggctcttctgggcataaaggcaaaactcctacctagcagcacaggcacagatgtgggaagcggccccagtgttggcacagcaataattttacattgtagaacctgcatatcaggcttgggaggcctagcttcctgaattacagaattactgattttatagtagatgcaggggcctgacaaggcaggggatgaaaaaagaagggagcccatggcgttatgctgctttgacctaagagacatcttgttctatacaggctgccgagacattccaattatgccttggtgagattcctgtattcgccatcctgcaccctccttcctgtgcccatcctcctgtgtgactatctacctgcccccacctgcctgtgcccacctgcctgcacccatgcacctgtatcttatcttgtttataggttttttccactgattatttgcttcaggagtaaactgaagtctaagttgtctttttgacctttttgtttgtttgaatacagttgttcattatccatacaaagttagttgcacaccacaggatgtgttctcagctctccctataccttctctttgcatctctatttatgtcattttcatgttttactgcacttctttattcagctatagtgcatcctaaaacaccttggtatttcaatctcagaggcaaaacctgaacttttaaagtcccaagtgttatgtaccttactttacttctgtcgctgaatcaaagaaagctaccatgaggatactttaaaataattcttattcctgtattattcataaaaatattgagaaaatgttaagtatgaggtgtttgttcctcctggaaatctttataaatactaataaagagtctttaccattaatgctgtaaatattaaccaacggtttttaaaagcaatccagaccatttacttgagtaatgaaatgcttttgatttgcacattttgagaaaattaatgaaagcaagttacacattattttttatggagcttgctcaacactcctagtgtttaaggttggaaattactctttcctctaaatcatgatgtttctattgtgtccagggggctacaggctacagagggatagaggggctcccacaaggggtaagaagaaagcaaagcaggcaggacccacctctgcctaaactaagctctgctttacctgcttcgtatgtcagagttctacgtaagagtttgcttggcaaaaagggctctggtatttaaaaagacagagtttgaattcgactggtaatgtatttttgttattattcaagatctttttttgggaataactgcaaaatagccctcaagatgtcagctaagggaattcctacatgccacgtctaaggggagaaagttgctcttggagtctggcattctttcccaagttggggaagttgtgagaaaggtcctagagaaacatgtggctctgctgaaaccaagcttcttttgcttaagagtttagggtaagtgatacacgtcaagttatgttcaagtcaagtaatgatagtaataaattactatttcacacaattgaacctctacgtacgtcctaaagcagttacataacaaaacactatcaccttccccccaaaggtctcttttgcttcttccaggtaatcactattcaactcctactttcttactctcccatatatgcccctagggtttcaagttatctaccagccatttgaatgtcttctttttgtgaaatgcctatttatgttctttgtatatttttgttttgggtgatcatctttttcttacaaatttagaaaaaccctttattattaagaacattaattctgactttacgtgttgcaagttatctgcttttaactttgtttttagttatttcctgaacaatttttatatttatacaaacaaacatatatatatctaatatataaaaaacaaatatattatatttgatatatcaaatatatttattatatattatatattaatatatattatatattatatattaatatatattatatattatataatatattatataatatatatttgatatatcagatatataaatgtttgtataaatatatataggtgtttgtattatatatatgtattcctagtatatatatatatatatatatatatatgtgtgagataggtggtttgtttgtataaatattatatatattatataattatgtgtgtgtgtgtgtgtgtgtgtgtgtgtattccaacactgtggtgttatacttaagctctctctgcccacgccaagattacaaaaatgtgtgttattttctgatttgattatgacacttaaacttttaatccatttaaacattcaattttttaccttgcatagagatacactcctacatccccacatttaaccagtagtctcaacactgctgatggaacaagcctgcctttccccagtgtgtattggaaacatgttcgattcctataaataacttgggcctaagccttctattctgtaagactgatctgtctattctcagaataatccaagttgttttatttatataattctataatatattcagttcctagagaactcccctctcaaaatgttcttgccggttactaccaacttagtctcctagaggacatccagaagtgtttttgatgagtttaaaaaatcatttaattattatgattagaattatattaagcccatgtataaattagggaaaaattaatcttctcacctaaaattatggtgtttttcagtttcaaaatgaggtaaatttaaaaaatatgactgcaattttgtttgacacttctctcaaagagatttcttgaatgagagagggcttgtggcacactaatcaccagtggggtgcagtggaagagatcctgtgtggcctccaaggcaaggtcaggagaggtggactattgtccaaattgttctcaggtacactgactttcccaagttcaactctcctaagcccactatgaggaattccaggccacatggagaggctttcctgtaggtgctctgattgacagctccaaatgaggtcccagctaagggccagcattaaccaccaaacatgtgagtaaagacgcttccagaatattttggcccggacagtaaatcaccttcagctattttagtcttcccagatgagactctagacatcatattccctctgtgctctgtcagaattcctgacacacaaaatccatgagcataataaaatactgcttaatgctcctacatttggagtgatttgtaaaacagaaatagttattggaacattaagtggtttttttttttggccttaaacttttatagttttcttccatagatattatactttatttaagttaactcttagttatttaatatattttttttattatggtgataaaattattctgactaaaaagctaccttctgatgtaatttttcattttctagctcccagtttcttaccttttgtgtagttattcaactttgtacatctactgcagtacatttctaaaagtattttatttgatattcttaggttttatagatatacaatcacacaatttaaaatgaacatatttgggtcttctccatttaaatattataaaattcaggtcttttctggtcattatattggctggtactctcagaacatcattaactcatggtggtcaagccagacgttcctaatttgttactgagtttaaggggaaggtatttcatgtttaatatatatagttctaaatatcatacaagaaaacaaaataatataatcatgagataaactctaagccctactattagttttgaaggtcatatattttagcatatttcaagtaattttttttttgctacatttaagtgggagaagtaattttggattactttttttatttacttgttcagagataggaagaaaatggtgaaattgctacttaaagcatgcttctgcttagctttagaaataatgacattctgctgaatggagcaataaaaacagaacctgcgcatgatcttgtatgctacaccagctgactaatccatctcctcagatggtttttcagagtccaaaaatgctacataaatttttttcaacctgtgtgagtggattattttgtggcttcctgaaataatcctctcatcttttaacacagttctgacccagtttgagagagtatctttaatatcttgttctacttcactgacctcaaggcagaatagccagaaatatatgcatttaacaggcaactttcatcttcaagctcacagaagggttggctttctttaaaaaggaaattgaaacttatattaccaggcagctttttagatgattttactttccattttataactccagcaaataggaagcagagatgtggagtgagtgaaggagatatgtggagtgaccaaggtgcctcagaatagcgcataacaattgatggaagcaaacacaagctgtcacagcgcctgcttttacctcaccattgattattcatcaggtgaaaggcactcatcccagaaagaaaaacagaaacacacgtatggaagacaaggaaagtgggttgctagaacaaaacacagaacaatagcccatccagaggagtgggctggtgaggtacttacagaacacaaccactctgagaattcacaacacactctgattccctgagtggatggttaggagcatgggtgttttctagttggtaaatgtgagactgattgttatggttattgcctgttaaaaataaattttattattgttcttcattatttaaatgtccttcttgcctttgcctcataacccacacacagggcctgctgtaggaggagtacatatctctgttccattgctaagtgaccacttctgagctgaaactctaagagtcattgtgtgtttctgccaggctttctcctttccctttggtgcaagaatagcatttcccagacaggggctcctccatcagtctggatgctggggggaagaccatggagcagagcagagctgtgactgacccccagggcatgaagcatgatcaagaaatacacctttgtattataaaccattgagatttggctgggaaaggtgggtggggagagggaggcttatttgttgctgcagtgtaactaagtgaaacctaattcatatgactcaaactaaggtatatttggttagatctaggtgagttctactttagaggaaatcctggtaactgttgtttgtttgtaagttatagctgtaattaattttccctgtattcaaagcccccaaaccctgcattcagatactatgcatttagacttccttaggcaaagtcaaggcaacaagctgatgattctaagctattattcaaggagtatctaccatcataaaggtggtttagtcatatagataatatcaatcaataatacaggagatggcaaaaattttttgtgaagagccagatagtagctgagtatgatgacccctaatctcagcactttgggaggctgatgggagagggtcatttaagaccaggagttcaagaccagcctgggcaacattaaaaaactccatttctaccaaaaactttaaaaaaattagccgggtatggtggctcatgcctgtagtcccaactacttgggagaccgaggcgggaggattgcttgagcccaggagtttgaggctgcaatgagccatgatcacaccaccgcactccagcctgggcaatagagtggcacactgtctccaaaaagaaaagaaaaagctacatagtaaatattttagactttgcaggccatacagtttctgtggcaaccactcaggttgtaagtgaaagcagccataaataatagaaaacaaatgagagtggccatgttccaatacaactttatttacaaaaaaatgacaatgggatgtgttttgcctgtaggctgacccttgttgtagaataagaaacacgaacagcggcgaacgaaatctaaataacaagcctaatgtagcatgttctacaactatgtttatatggttttaaaattaaaagctatccaggagccattgaagaacatggttaagttcttggttttcctatatgtaaaatagagacagtagaagttatttcataagatttttgtaggaattaagatgaaatataaagtgtgcatgagtgagcaagtgcttaatgaattccagcttctttaatctttctgtgtgctactattcaggactcaaagtagattattagtgaaggcctatttaattcatgccaagttaatgaatgaggtcaaacagtaataaggtgaagcacagaatcctttaagtcgacatttgccgagcaattcaaacttacggtaatgaagaataaatattaatatatgtcatgatttacatgtctatcaattagatccctaattatattgatttgacatggaaatgctttatttttattgcgggggtacatttggaatgatagaaaataattatctgtgttccacacccaaatcatgaaattctttcctgcatggacaagggatagaaaataaaaccctattgctatctgctatattaagaagctgctcaattaaacagaagtcaattttgttattcattaaactcagattgagacatcaaattttctttcagaaagcagtggatctcaatatgttgctctgtgttctgttaaataccttccatcatgaataattagtgtcaaatgtgctcagaagctcatggccaatattcatcatctttggtgcatgggccatagtgacaattgttgagatacctgaactttttctttttgtaaatctaaatgccaccagagaaaaatatatttgtttttccaatacattctctgcctgatttaacgtttaaaatttatcttcctaggcctctacttggagttcatcctgttccaaaatattaaaattctcttcccttattctttccatttcttcttcttcttctccttccccttccccctcccctttcccccacccctcctgctcctcctcctcctccttcttcttcttcttttttccttttattgcactccagctctgttgcccaggctggagtgccatggtggggtcttggctcaccgcagccttcgcttcctgggttcaagcaattctcctgtctcagcctcccgagtagctgggattgcaggtgtgtgccaccatgcctggctaatttttgtagttttagtagagacagggtttcaccatgttcaccaggctggttcgagacctcaagtggcctcaagaggtctggcaggccacagcctcccaaagtgctgaaattataggcatgagccactgcacccagcctccatttcttctccattgttaaaattacacactttaaggtaccactcactgcagacctactgagcctccagtctctaagaagttgtttctagaaatacaatttttaccaaattttcccatgattttaatgtgaaaccaagtataagaccctccttattaaaggaacatgaagaacatgagagatgctaatagtcatcaccatcaatattttcacaggggcataaaaaacagcactagggctgtgataagggtaataaggtgacaggtgcaccaggtgagacaggtgatggggtgataaggtgacaggtgggccaacaattgttaggaggagttttcttctctttttactttgtacctttcctttagctaagaacagtgtctaatcctgggccatcagatttcttacacacagaaatgccaacacataaaagtgacatataagttggagatgcaagaaaacaatggacattaagataattgacaataaaaatttccattaaaataattgaaaatagtgaaccagatctatcatatctacaaaattattgtctataaattcaatgttgtattttggtgttcctgatggccagcaatgcaggggagtgaaaatgagatatgagagtttaagcattaaagggcagaaggatactgagaaatccctcagtgaaacaacgcaatttaggccaggaattttccactctttatcctcacaggccctttttggtaccttgtgtaattatagcagacatatagggatgtctctgcaacatggtgcctgtcaggttcctgcgtttttctttttgcctctcagatgatttttactatcacaggcctggggaaagtgatttgcacatgaagcattttagcagaccaatcaattagaatcagcctttttctgtttatgtcaacagccaaatgatcgtgagaatacccaggccatttgttacctcccagggatttagcatccagcaccttgggttgtctgaagttctttccagggagctgcctccagaccttagacacaccacgagaaaatgtctccttggctactgacaataatgaatcaactgcataaatatatctgtcaaaatgatggtgcatttgtctatctgaatactagagaaggaagggtaggagagagtgaaagaaaggtggaattgagtagagtctgacacctcacaaacttagcaattttggtaaaggataaattcacatctacccatacatttctttggacatctgtgcagaatcctcaaatccaatttctttggaaaagacagtctccaatatattttctgaatcaaatggatttttagtttgtttgtttgtttgtttgcttttaaagttaatttataatttcctttgaaatgaagactgtagacatggccatatctaagagaatatgaatgaaagatttaaataggggcattcatggtcaatccacttcctttgtttatcctatcctgtaaatattttcagtctactacccatctgtcactccattctcctgattccagctcttatcaggattgtggcctgtggtttaactgactgcctttgccagagagttaaaacgagtctgttcctgattcacagcaccagctagatcactagggccactaatgatgagtttagcaaaactccctgccaataacatgaaaccattcaatggctgaaaaatgcttcctgtctgaattaaccccccaaatatttacaagtacagcctacaaaaaaattcaacagcatgcaaacttaattactcaacagtgatgaaaagtccacttattcttgaagccagagaagggaagttaggtgagttagaaagggatgacttggtgttttctcaccttcctcctggaccaaatcaatggcatagacactatggattgatttggaacaccatctagtgaaggatatgaggaagcgcatggacgtagaaaatcccacatcaactcctggttcgattcatttaacatttcctttagactattttaaatggttctgaaatgaataaggatgtaatttttttaagttatgaaaaaaacaaaacagaatgaccagtgtgtactccagcactgaccagattcagctaatgagtccacttgcctctttttctcttagcacttccccactgactacagtaaggatgtaagaaacacccccatagagttgatacaatcaagtttccttctgccggaatgtcagcatctggaatggcaccaaaggatttgagaagaatgatgccaggacaccagattttcaaacaagcatctatcagccatggtatttttcagttaaacaatatatgtgtaagaggctttagctatcaaaaaatttaaacattttctggaactcaatagcttttatcgtcagaaaatcggtaccaacagcacctatttcacagtgtgctgcacacaaaaaacattcaataaatataatattgttcaataactagaggtggcagctagaatttttaacctgggaagaaagctgaatataattcaaccgttacattttgaattcttctatataaaactgtgtcctcaatttatttatttatttattgaacttctcaactccacatttcaatgtcttaccccttgggatgttgatccatgtgctgttagcactgaataaatattatatgactgcctctaaacttcccacagagggaaaaaaagacaaagcaaaacaacaacacaatccctcacattcaatgttgtggttcttttactataattatcaattcccgaatcaatcttgccttcatgtaccctagtctgactttcaggaaacctcactgcactgttcctgattggaatcttgctttgtgttttctagcggttgctctgaagtcacatggtcagcctgccatttggggtatcatagtttctgtgagtaattgattctatccagtcttaaatggaaataaatgctgtgtttgtattgctcagcatgttaaattttccttttaggtgaagcagaaaaggttacataaggtctgaaagcctcaatcataggccactaggaacacagtgacctcccattacactcttggtcttctctctaaaatcagaagaaaagaagactggccagaatgctggagtgtctctcactttctcttttcaactcttctattgtttgaacaatgactaattagctgtcactatctttaatccagcaatgtactgactaactcatgcctatttttagcaacaggtgaatcttaggacatttcttcaagaagccagcactttagactaatgggacctactttgatcttagagaacagaacagttttcaaacattccaactgtgcttccctgattttgtgtgtctgtgtttgtggtccttgaaataatagagaaggaaggtttttacctagcaacacattttcaatctgctaggcaacacctgagaagcacctgaaggcaggcagaagtcctctactgagtggtttcattcgccccagctgaacagctgacacgagctcccgaggcactctactgaggataattagacttatactcagggaccggcaataaaacatgaaaacaactatgatataaaatgaaatgggctatctgtcataactgaagaataaactgtgatggagatttaaatcagggtattctacagccaatgatgagggccaatggaaaagagtgctttgggcaggaggttttgtactttagacaaaggtcagattttgctgtcattcaatcagctgtgtgttgtgtaggcaacttattatcattcaggttacagtacaagaatttacaagtgactcctcctcctctttctccttcttcatcaaagtaaattagaaaatactgcagattatccccatataatattcctctcactcttgctctgaaatattttaatgaatgggacagaaggcgctaaaattacaatcagaagagcacataactggagatgctggtttcttacaaaagtacttatttctttatgttgttgttctggtgtgattattgatagtatccttttcagtttcaaaaatgtcctgagttgggcaattcatcctctggtcaccagacacgcaccaacagtctatctcatgaaagctgtaacagcacacggagtggcacaagtgggtatgatgcatcgtccacatccactgacatcaccgatactgtcggcctccctctgcttaggcttccaaaacaccaggtctaccgagatgcccaaacaacattgcaaaggcaaggttatgagaaatgccacactagctgtggaaagagtaccagttgatgtttccagtgtaatgaaatgatgcaaacgcccactgtataaaaatttccgtctatcccttctctcctcttgcagccactttttttttttaacacaattgctacagctaattgtcaatattaacaacacacgcacacacaatataaaatatacatatacgtatatgtaatttgtcctgcggcttcatatggatttcaattcatatcttcttcaaactaacttattttcagcttgactaaaaagttgctaattcattcgccttagctcatttttttattttcaatgaacattagtctctggtggatcctataataaagcattatacattttaaatatttttgaaagacagaggacattatctgaaacacaaagtcaacctttgtaataaatataaaagaagcgtgctttgagagaaagaagtaaagaactattgagacaggagaataggaattagggtaaccggggttaaggcataaacaaaagaacaacaggtgcagccaattcgcataagcaaaagaacagcaggtgcagccagttctaggcaagattgggcagcttacgggccatatcctcgctcctgtgataacaagacaggagtttccagttcagcctctgattgagggccaagcctcacttcagcctctgattggtcacaggccaatccttcaaagggcataaccaattggaggcctctaaagggcacgtggggggtgttgccaattcttttggctttataaagccctgggaccattgtggtaaggagactcttgagccgcttgctggtgtttgtttctattctgtgagttgtcttcgctcagtctgtgctttttctttccttactccgttcttctgttgctttgtctttcattgcttcttttattccttcgtgtcttctgttcaacattccgagaacctgggtaactagaacctgggcaactagatcttgtaatgctatttgcctatgaaaataggcaagctggaaatatctagtagactagaaaaaaggctttctagaacttgagtggaggtatctatagaagataggctaatgtgaaaactgaaagactgaaacagtttgaggaattatctccctataagcccaccccttcatctagtcttaactacaatcgtgtctcatagacacggagatctatgcactgagaaactgaactagatttctgctgcgctggtgccccccgatggtctcgccatttcatggctcatagtttttagaggaaagtcccttggaaagctttttttgtctctgactaaacacagaagtaggattaaatggcagggctaaatctagcttcccttttcatccccaaccaatcttgtttctctccccaatatcccattgaatggcaaagggtaatgaggctgaagatgaaaagaacaacagcaaagacttactgatggctgtctaaataagataggacgattctgaaattaaacccagtaggcagaatgcttctaaaggctacccaggcccatgtgctgaaacctatttcgttaaagtactgctgtggtttctcattccacacacacagtggtacctgactgagtacttcactgagaagcttgagcagaagatgcggctctgatgtagtgctgttaagttctctcaggtaactttagggttttcgacagcttttccttttaaacttaagggaggctagatccacaaaccgagcactagcacaggctggcacgaaacacagcttaactttcatttcaggcgttgtaggggcctatctctcttgctgacagttacgggtgcagtttaagcacaatctatttaagtggtgcaccttgcatggagatagacatgtatggtgaaagaggatgggagtaacaatggagtctgtgccgcagccagtctctgcttttagataatgctctgtatctagttactataaatttgggatagccctggcgatgaggatgctgtgggacactgtttgcttctttaaatcaccataaccactcataaacccagtctcgaggagttatgcgagtgtttttctctgtcctttctcttaacctgttccccttaaatatcgttacaagaaaacgtccactggagcatacttcatagcactgtgacagtagcagaagggagaaagtgactgttctagaggaacttcccccagctcttagttcctttgagtatttagaaagtggagtccaaagatttgttagcatttgagatgttaatggcaggttaaaacaatctaggctgctggaagacaagagttttctatttaagttaacaagataattaagttctcaaataactaaaagtggctagaagtcaaatcagtataagatgatggcaagctggtagggcttctgaattcagttgagaacacaatcctcgttttttaacttggttttgaacacttcattgtcagcagtatttaaatattaaattttaaaaatagattcctaaaggagagtcataacgggcatcttcttaaaccagctactctttaaaatcaaaatgctgtcactgccaataaataagtgcagtgtctttttcttatgggtgagtcagttatttagtctgatttcaatcttctaagtaaccttgcgaaatattaaccacgctacacaggccccacccctgactgcaggcaagcagaaattcccttcagattgtgtgaatggagatagttccaatctacgttacatgatctatacacaatagtatgttttctgacatttattcctttgattcagaaattcttcctcaaaaccatgtattttgaattctagtttcaaatatgtctttgaaaatatccatggcaggtttgtgcataatttgcattttgcttatttaccttggttgaggtttttccttagtttattttttaatttttaggaaaaaattctcaggttttttcaatcctaaaaaaccaaatttaaggaaggatagtttctttgtagaaaggtgattaatgaaaaatccctgttcttgctattctgtcattgagctctttcaaacaagcgtcggaagaccaacagacttaaagataacttgttttcttacagtacttaagatcactcttgtttacttgcgggatgtggcttagagaatcccagttcatatttagataatatgaggaaaccaacgtgaatccagtgggcacaagtacaataaatgaaaacttaatttgctttttaactaaacttacaaatacatgtgttcctatgcaagatttatctaattcataaattgcaagaaaacaggctagcttccttgtacacttaaatctctgaggctcctcactcaacttttgttttagtggaccctgcaaatgaggtaactagaccattgatgaatccagaagagggaagcaattgcctaaaatgacatcactactgttagcacgctaaaagccatggccacctacggattttcccaaggaggactgaggtggtgagggctacttgcattaccaattgtattctatattttccaccttcaaatagtaaactaaattagtcacacaggctttcctgaaaaagcgtctgattgctaatgtgcctcccaaataagtaaaaacccttttaagaaaaatagacaaggttgtggattggcttttgaagtatggcttcatccttttttgctttcctcatggattacaagttcaatgtgaggggcagaaagcctaccattttattttttcaagatgtgtaaaggagaaccacatgcaagccttttgtgggggaacaaactataattctgtcaaactgatgaaacaagttatcaagtaatatcttagcttccttcaggaaagaatatgttggggctacattctgataggatatattcaaccataagccttaaaagcatgaatcctaaagggatatagaaaaaagcctcataggaatgccaatgacggactctcgaatcttcaggagttctgggagcatcaagaatatggagtccaaattctaccgctaagctgacagatgacaaagagtgtattacctcaatggctaaatatttaagcttcatggagtttggaagatagttgactgtaaatgagccaagaatacaaaaaaaaaactgcctgtgaaattatactgcagacataaaatctcaactgcctaagagctctggttcttctaaaagccgtggctgacagagcaaattaagcagtgagatgtttactatgtttaacagagataaactggcaaatgtagaagatgtaattacccagcatgtttttctaaaaatgaattttaactctgttctatgagggggcaaaaactgcagggcactgattttttttctgaaagtctcatgtgcttgggtaggatttttaaattattcagtaacttgataataaatggtcaaatattgaaaaaccaagagactttcactgaggaagcagaccaaaacgggggagcactttagcattttcagcatctctgaaaagatttctggttgaagaatattgtttgatctagcaagatatccagaggatttagcctacccagggacaacgcagtgcttcacatagagaaaattagccagttaaagctgacttgggactctatagtgaatgtcatacagatgacctcccaccacaaaaactaacctgtaccttactgtaaatcatatcatttatatttgtcttgcatgcaataggagataattactgactaaaatattcaaagatgtttacatggtgaaaccatcagcttgatttattaacctggatgcttttcttattaaatagcaacaataaatggagagttccaagccagcttcttggaagaagatactattactaaaaaacttgtttttctatgtagatattctaataagctaaaaacttctctaagccagcactggaataaatacaaagattattcacacatctaaaaatattacagtaacctgaaagataagtgaagacttctccccctaaggaatttcttgggcctgtcctaggagggctatctcctttgcaatatgttacgacaggaaatcgtccatttttgcttgtgtgtgtgtgtgacagttgtagaaaatatatactagcctaatagcggtagtgtttaaatgtctgaatcccctgttagactataaactcattcaggtctgggagtcctccttagaatagtgtctgacacattggaaatgttcaataaataattgttaaacgaatgaatgaaacaaaaggcaaatgtctagatacctatgttgtgattagaaaaagatttaaacaaatgccaaaggtactttttttcctaccaagaggtcatcatttgcatacataacattcatacacagttccaagtcagctttaaatggctggttcctctgtgtgagccactgctatggtccctggtggtagactcccacaagctgcctcctatatgcagattaagacctcagctgcttgatagttcacacagtcacctcacccaggcctcgcaggagaaaccttgggactgtgcaggagacctagggctgtgcaggaggagtttcacaaatgttttggcagcagggaaccagcagcagcagagatgaaatgactcgccactcttcggggcacaggatctagctatgtcaagcattcattttcactttattttgataaaatgtttttatggaccatgacaatgaacatggagcttggtaacaagagaaacgtaagttctgaaactcagctactcaactgatctggcctcagtttcctcctacataagatgagaataagaaggaaattgactatctaggattcgttgccaagtccaagtgagattgtggatgtgtaaacacttgtcaagccataaaacactctataatgtataaagttataaaggcatctttgtggtagaatgactgcaaatatggtaccaattatccttctaccactttttgcactgtgcctttgaagttcctactatcaacaggtgaagtctattcctcatctctgtaatctagcctggtcttggaatttgctttggttcatagaaaacagcagaagtaatcgtgtgctaaattctgacccaaggcctcaaggtaacttcctttgcaaatacatttgctctcggaacactaccactggcagaacaagcctggattagcctgattgggaagtagagatcatgcggaggagagtttagttgtcccagatgaggccatccttgtccacccttcagcagcaaacacagccaagatccagcagagctccctacctgacccatagctgatggcttgtctctcttacacttgccaagaccagtagatccatccagattcattaggaaagataggcttgattgtgtttaaaccactggagtttgggggtagtttatgtagcaataactcagcactagcctccaaccagagtccatgggggggacatgtcaaaggagaggggtaataagtagaaaatgtgtgggtcttgagaatcaatgacagctgtttcagcattacccctcagcttcctccatttccagggtgttggtggtagtcacaacttctggctcacctcgagactaaggctgagaacttctgatctcagtagaaagactgctcttaattcagagtgccatgtgaaccgctatacctctgctcccaaaatgtgattgaaaaaataagaaatggcctcctggaccttcatcaaatatctaagtatgctgtctcaatcaagagtcaaatactcagatctccttttaaatatagcctctgaaatcaacctacccagcctgacatttaaaaatcagctgataaaggcaggaagggattagttagcaaaagtgggaaagtgaatagatcagaggctagatcatcagaagcctataaaaagcataaatgcttaggacaattcgcatggaaagtgaaaagaattaaagacatgaaagggaaaccagttagtctctttatgagcaggtatatccttgctcacagaactctggctgtgtacagccttaaagctaatgtaatgctattagtaaatattgaggatgattacaggcccatggattagtggatttctgctttaagtttgctgtttattttctagggcacataacccccccacagagaatgagtaaacacagaaggacctagaattccaatcatccaaatagttcttgggattagtagatcagattcacaaaatcacaagaatttgaaggagttctacaactcctacaaatgtagtcccctcccctgtttaaacagttctagtccgtatcttctggatcccaagacttccctcttctcttaccagaatacactaatagcaaagctgctcagattatcagcagttcagcaaaatcaaaaggaatatctgagcttaagatgggtcagttacccagtaccaataaatgcagataacacttattgagcatgttaccatgtgctgagtaccatggtgtttattcattaatccaaatttgttttctcaattccatgagttaagtattaaactaattttatagacgaaacttctcaagatgcagcagcttgccccaaaagcttcatagctttcatagtttcctgcacagccaagagcaaaaccaaatctggatgataccaaactactctctccaaccatcaaacatcatgccttggctttactcaacattctttgcctttgtagtacattcctatctgccaagtactatccacatacagttgcatgcaccaagtatgtattcttagtgaacacctttgacagcttggtggagcactccactctctgaaagagcccctccttagctgatgagttttctctgggctattctttgcagcctccctccagctcttccttccgtcagatctccatttcctacactttgctccgtattgccttttatctttcccgtcttcccctcttctcaggaagaaccacaatgattgtgcttgagaactttagaatcagactggctctgagtaactgacaaaaaaacatgagatggtaactacctcatagagggtggttgagaggactctaaatgagatcatatatgtaatgggcttagcacagtataagataacatggtaaatgcttaaatataaatgtggaccttctacgaatatatcaacttggtggaagaagagagtaaaaactattcctggattcttatcactgagataaaggttttcatggtgactccattcaagaggactccattgtatttccataaagcaagtatttatttattgcctcataatgaagtactttcataaacagaatcctatgccatccttgccattaggcagcactttgtaaaagctggtacaagtgtcgcccttttgatagtcttccctgagcttccagtggaatatataggggatttgagtcaacatttgatctccttctaaagtcccttcctatattgcagaggcttacacatttccaaaactctcttgcagttagtctgatgtaatttaaagtgagccagccagacatacctgcacataatttcaaacttgagttaggtgggagaagagtcataatgattaaaaatccgttttttttccagtgcagatcacgatggagctggttggatttagtgctggcatctcgtaaggcaaatccacaattcgacaggcctctgcagattggagcagaagcagcagctccctgggcagcccagttctagggtaggacttagacatctgtctctttagctctcacaatgattatgtaaatctttaattatctataaatctttttcttccaaaattagccagagtatattctactccctgcacttgatttctaaacaatagctaagaggagctcttgcccttctttctgtacctccagtacttgttcctgctcataattcttgttacactggacattttattacagtaactcttagaaacatttatcttttcctcaagttgaaagcttgatggaaggtgctatgtcattttcacctttgatatttcccatagtgcttggcacaaagcatttgctgaattgaactgagacacgttcccacagtaacactgtggtaagctaaagcctaattttgaattgtcactaggttttattccacattttgtacattgctgaactatgcctaaacctgttttttaaaagtgaccatctttatttgtggtagattaggttcttcagaaatacgcatatgtatcctcactacttcacttccttagaagtaacatttccctgctcgactgccactgggtttgtgcatatggctggatttggctaactgtagcatagtctccaatatcttttaaggttgggcttagttatgagattcactatggccaagctaatgtcggcagatataacagactcacaaaatgctcttatgcaggtggacttgtgctctatgcctctgtcactcataagaacatgcctcagtaagttgaagaaagattcacggagccacagccactgccagccaagtccagcctaaattagctacctaatatctcctttttacctgcagattcatgagtgataaatgcttattgtctcatatcactaaagttttgtgattgtttcacagtattgtcaataagtcatgtttctagagaaataattctttcaaagaaaacttggatgtaccagaaagagaaggcataccctggtatgaagtttaatgcttccctgtaggacacttccttcctgcacaatcatcttcctcgaggttcatctccttcgtttccatagcaatacatattactcataccccagttacttactggcttgaccttacatctctttgtgccttatcaatagatgttcctcaatttttgcttctcttcattaagctttagtctcttttaaatatcattttcagggacttgtatcactctgtgaaactcctaaattctgtccaaccctgaacttgtcatagccaccaacttctagctaccaacagactgtgtctagctggcattcctcctaacatcttacataaaactctccaaaccacatccagcaatatttccttctgtttcctctttctcttaccatcttccaggccatctatacacaaaatctgttatcttcctctcaccataccagactccaaatttaataattactacgtatcttaagtgctctgacaaacattccaaaggatttaggctagtgaagcttctaatttgaaggaatactatttgaaatcattcttgtaaagcaatgagtggttttggttatgtgacttggccctgaattgattctctaatcttgggacttctccacatgtttttcttcaggtgggggcagggtgatgatgggcagcctgtggagcctcaaatatactgataaagatgtcaagcagtcatttggtagaaaggaaaggacatagggaaactggccattcctgcttcaactagaaaattaaaggctgatgtcctgtgctgttctaaaaaatcaatggctaataaatatttacctagactggcaaaacaaggattaaaatttaccatgcagaacacaacccacaaaacattttgcaactagtattgtatattttgaatggaaaaaagctatcgggtttcatataggcatttaatgaaggatctctgaagagaccctggacgtaaatctttatattgtatgctttatttactttaataaaattccagctttcctctaaatcaggctatatttctatcacattatatattgagagatgttctatcgtggatagcaatgagaattctgagtctccagggaagaagacagctagagcctctcagagctcctcaacaagctaagctaaaattgactcaatattggtgaattctagacacaaacaactaagttaaccaaatatatgtgggacttattgacaaaacaagtagccaagtcttcttccaggcacccagtgtcggtggcgcacacacattttcgcagtcaattaactacagaacctgggggatagatatgtttatttttactgcatggtatattttagctcctatactagccaaatttttagtgcaaagaattattgagtaagcttccttccctgaatctgaagctgatctttgttctgtgtccaggaagtctgagtctaaaccaaactttatccaattgaaactatcaatcctcatcagtctgtagtaactttttaaaaaaggaatgagatttttttagacatatccatttgtgtgtgagggaagtagacaaagtaacatcattagaccagtaagtaaaaaatctggaacactttttctaccttatcactagagcatcccctccacctagtagctctaccaattagattcaaacctatggtcaatattttgaatggcaatcttgaaacagcacaacacaaatgctgcatttcacaggatatataatatgaagtttatatgcatgtgtatatgtattatatgtatataatatctggggccgtgggagtgagaatctaatagagtatctgaaaccaaggcacaaaagagccgagacagtgagtacaggtcttgcaatgtgacgtgggtaggtgagaggtctggatgcaggagacagtctacatcaccaaatatcttgactgccctgcttaggaacccatgttttatagagaaggcagcaggaaagtctttacatagtggaatttgaaggagtcaatggctgtttatgcaaggcctctaacagtgaagagaagaggggcttggggtagtgacgatgctaggagtaagtgaattatgttgagaaggttcatggcagtaatctaggtgagaaaagagaagtgaggacatatgctttaaaaggcttccttttctacctggtagttcaatatataagggtccttcgaagactgaagttttcatgcgatttttgaattgtcaagcatgaaaaaatacacaaagcatatctgaactcatgtacttcaacaaacaacttcaaagtcagattagaaacttaacatttttataataaacttttaacttttgtgggcaccatagtaggtgtatataattctgggggtacataagatgttttgatacaggcatgcactgaaataagcacatcatgaaaaatgaggtatacattccctcaagcatttatctattgagttgcaaatgtcccaaccacactttttaagttatttaaaaatgtagttattgaatagtcactctattgtgcagtcataataggtctccttcattctttttattttggatccattaaccatgcccacctcccagacccccactatccttcccactctctggtaactatctttctagtctcaattgtttttgatttttagatcccacagataactgaaaacatgtgatgttagtctttcttttccttgctttatttcacttaacattacaatctccagttcatccatgtttcaaatgactggatctcattcttttatggttgactagtattccattgtgtatatgtaccatactttatctgtagatggacacttaggttgctcccaaatcttagctattgtaaacagtgtgctacaacaaacatgggagtgcagttatctcttccatatactgatatcattttaggttgacaattaaaaatctagcaccataaataggtaaagtcatgtgtcaagtagaactctgtatgtgtatttatacatatacatactcctcagcttacaatggggttacatacccatgatcccatcataaattgaaagtattggccaggaacagtggctcacgcctgtaatcccagcactttgggagtccgaggctggtggatcacaaggtcaggagattgagaccatcctggctaacacggtgaaaccccctgtcgctactaaaaataacacaaaaaattaaccaagtatagtggccggcgcctgtagtcccagctacttgggaggatgaggcaggagaatggctgaacccgggaggtggaacttgcagtgaaccgagatcatgccacctcactccagcctgggcgacagagcaagactccgtctcggcggcggggggtgggggtgggggggaatattgtaagtcaaaactattacacctaacctaccaaatatcaccacttagccaaatctaccttaaatatgctcagacttagatgattttgcccaactatagtctaagaggaagcctattttataatagtgttgcgtatctcagaatttattgaataccatacgttacatcaaaattgcaacagtttctcacattgtaaagttgaaaaatccttaggtctaagcattgtaagtcttaaagaccatatctttatctatctctccatctatagagatatagataacataatccttagtcagcttttgaccagaaaattctaaatgtgaagatatcagaaaatatcaccttaaaatgatataatttggttatccatatttgaaaaatgattttataaattctcttgataataaaaaggaaaaaatcttcccattgacttttttcttaacaaagaataaaatacataaaatatttctactaaacaaacctcaaatctctaaatgaggatacaggatttaaaatactccgtaatttggtcagaatagcatagaaagttttaacattcataaaaatgcaaatgtacattatatatacttatgtttattaaatatattaacgctttactgaagtgattttatacttaaagtttttcaaaacttagttcttaagtaactgaggacatgaagaaaaattctcttaagagatttttagatccgagtcattttccctactcaaatttgtaagaagatacacagtagaaactaatttctaagacatgatctgatagattctggtgtgtagactctaagagaaaccatgcaaaatttgttagattacacttaaaacataattctcttgagttatgtaactcataagaaaagcgaaactacaagactccagtgcattataaactgaatcaaactgagctttttttcctgtaaaaatggaagtagagccaagtgtagttacattttctttccaactctttcgtactacttggtcccttgttatttttctaagccccttgctgagcattttattagaggaaatcactcgagaagcatgtcccaagcaccaagaacagtggaacacaatagatgctcaataaatatattgtttgagtaggcaagttcccatgtgaattctctgatcatcttacacttaagaattgttaactcacatgatagacatgattagtaccaaactaaactgccacagtattctagtccacctcggtatacttcagtgtcggctcaccccaggttgtactgacaatctccattcggaattaggcaagtgatattacagttgactaaagcaagctctgctgtggcactgccaacatttgaattatccctacctacccctaaaacagtgaggcactaccatttctagaacatcctgcaaagaggggggacattttcataagaaacagcataatccaaggacagattgcaggaaaagtctgacaatgcaggtttagccatctgtagtcacaactgcaaattgactttttccttccgaactgatgatttgaccagcagaaccaaaactaaatagcaacttacaacactaactgctagatttacgcaagacagaggtagttccctcaaaggcaacattagaagagccatcaaaatgttcatctcccctaacatgtcttccttaagctgtccttatcccgaattccccacatggatcaccactcataagaagtggtggctctcggctcttcctgcacatcaaaagccagataaaaatatgatcctaggtttttactgcagaccaactcacactttcaggatgagtagtcatattctgtaaaactacaggtgggataatggacaaagaacaaaccatgatgtcttcaggaagccacaataagcatataagttgcccaaatgaagttcatgccttattttgctgaatgaatcaataaattattttctatgcatctactatgtgataacattgtgaaaacatacaaggacaatcaaccccattattaaacattcagtaccagggcttgcttcatgggtgtgcaacctgtgcagctgaacaaggccctgccctcagaagggcatgcttggtttaatgctcagctgtcagcatcttaaaactctgggtaattttgaaacaaggagccccacatttttattttgcatgagtttttgtactagccaggcttggaagggttgaaactcaaatatgaccctaatgtgacacattgtccccaccttcatctcccctgcaatctactgtatcataggggaattgtaatgcatcatccctatgcttaaaattcatcagccattttctcctatgcattgcataatttgtctgtttctctcgcctctagcttgacataatctttcccaactcccctcccaaatattgctttattatcgtaactggcaagacgggaagaaaatgtgtcataagagtatatgaaaaggggtactcatgctcaggtgccaggaaataagtcttgggaaagctgagaggctgaccttctaattttaaattggagtcagacataaaaattgactgtattggttaaatgatattggttaaaagttataaatggcttacaaaagactgcatcattccccattcagaggaagaaacaagtatatatctgaggcctccaggaggaaattgaacatggggcaccaagaatgaagaggtggtagaatataggcacaaggcatcagggatgaaagcagagagaaaatactaggaggtaggaatgctaaattcactctcattaaccctgagcatcagggatgtcttgaagatgtgcaaccagcacagtcacacaagctcctgagctgacaaggggccccatgcttggtaatgctctactgtggccatcttgaaatttttagtagtttctggaaaaggaaccccacatttacttcacatcaggctctgcaaattatgtagcctgtcccacttagcactatgtgaagtggtttacatgtactatcctatttagtccctgaaaatccataacatatcattactgtgattttttttctcttaatgaggaaacaggtatggagtggtaatgtactgtaccaaaaggcacaccacaaagatgaagccagaactttcatccaggtttttctgactgccaagccagtgtgtttttgatgacagtgataggctggctttccaagtaaagacaggagagagcaggtggctcagtcagctagactgcaggggacataaataggattagcagaggacaaggtaagaaggttgagtaaatcagatcactgtagtccctgaatgatcatagactttcctatgggacaaggggggaaacatgagtgacatattgagagttggactttaggaagtctattattgtgatagtgttaaggtattttgttaagcaaacaaaaaggcatggagaagatatctggggctcatatagtccttcaaatatgaggtaacaggatgaataataatgaaagctaatgtttatcaagcatttactctgtgccaggcactattctaagcactttggtataatgcttaaatactgtaatccccatcaaagttctgtgaggtgcaggtagtttttaaatatcctcctgttattgatggaaaaaatgaaaaggaaagcaagtttcagtaacttgttcatggtcatgcagccagtgagtggcagaggcattatttacttcagaatcagtgatttaatcttcaataagaatatttaaaagatgccctttttaacttaaagagttctaaaacatataaaaatgaaaaatattaaagaatgctattttacaaaagatccaggaggatagagtattagcagatttgagaacctatcgtaaaggaaagccatttaaatcctttggttcttggcacaaaaacagaaacgcagatcaatagaacagattggaaaactgaaatagtttttaaaattgtaacataagaccccataataaagtgttaggaggaattaattagaaaaacttgataatactttgaggaaatgatcaggttagattcatactttgcatgatacactaaaataacttctacatggattaaggatttaaatacaaaaaattgaatgacagtaaagccagcaggagatggaatagaatatcaggtttataagaaaacagtaacttcagctttgaagcagtggaataaattatgaaggaaaagattgacagatttgaatacataaaaaatttaaaacttgctgttttttcatcgtacagaagactaaatacaaaggatattattactgaaggccatatttgcattccatgctacaaagacagctttaaaacccaaaccatgttacccttattcaaatttataaggaaaaacatcagatctcaaaatataaatacttaaaatatgaaaaaaatgaatacactgacaatcagtaaagagaaattgttcagcctaccaacaattaataaatatgtgcaaaataaacttgagataggattttttaccttctaaataactccccataccccccccccccttatccttataacacccaatgttagttagattgaagcttgtgtactcattccttactgctggcattgcaaatgtatacagacttcttaaaaattagtaatacaaagctaatcaggctcaaagctgcatgagttttttcaggcagcaattacattttgagcactttatcgtctggaaataatagcaaaagcagatgtgagcaaaagatgttcatctgttattgtttacaatagcaaaaccctggaaacctaaatgccccaaattgagaatggttttataaattatgagaagggactacttgttatagagggcaagccatttgaagatttttattttcaggagtttggtccaaagggatgaggaaagagacagtgaagtagcttgaggggaaaacattaaggaaaaattgtcatttatttcattgaagccttggacatatttatcaattgagggggaacaagatattagaggaaataagaatgaaattttgagaaggagaagagggggagagagaaggggtggggagggggaggagaggcggagaaggaagagtggcgagactggaggtgcaaagacctctgaggcacaaagaagcctcaaaggcaaatgtggaaaagtttgctttggagaagggatgtgacttcctctgagataaagatgaagaaagaaacatttgaagtgaagagaaggaacaatttgatctctgagaatttgacttaggtgagtctttcttggtctggcagaaccggataccctgacacctgtgatgctgtaactctataacattttcacagcatttgttcactccgcatttagtgtgtcattttccagctgtgaacgaaaacatgagcaaaagtgccaccagggggcaggctgggcactggcaaaagcacttcaaagagaccatggaaaaagtcttttcctttcagcccaggggtctattctttgtttttgcaacaacaaactgcatcaagtccagagcattttccttaatggttgtgttgtgggtatggattttgctccatgaactcaagtgtgcaagaaatgtcacagtactgtactttattttctctaaataaaattaaattcaactgcaagccaccatcctaggcaaggctgaaagtcactcagtcattattacagctcccacagccccaaagcattctgtagagatgaggatcttattcagtgctcgtatttaggtcatcggtccatccagcgactagtgaaatacttatgacctgaaccaacatgatgtcttggtacatggtgacagtgctgtatccttatctgttaggataggggcagaagttccaatgtctggaacgtatgcacacacgcacacacacacacccagatacctccttaggttacgcaaagagggaagctgaggatgattcctatctgtagaaattgtctcctgtaccctcttctggcttgagggaaattcctcctgcttcccccctgtgcctgcctctttgtctcctctatggtctaatcatgggccagcttaggctacaaagaacatctaggaagatagacatcttcagaacacacaaacttcaggagaggcattgaagcccagaggccccatctagttcttggaatccggaaaggagaaaacacaagatcaaaatgcacccacacccatatgtctaaactgtgttgccacatttgccacaaggtcaccgtccttaaaacacccactacttgacagatctgacagtatgagaccgttatcttctagtagatgagagagctcaagcatccctcagtcgatagtgggccaatcccagaactgctgccatggaggagcaaagatgaagggacaaactctcatctcaaggagcttccagtgacacacaggtaatcaaggactgacgaatttaggtaagatattacacatttctaaatcacttaccaatattgaaaacattaaaaacaaagggttcacgtaatcatctgtgtattatctagcttctcttaaaaataagacccggcaaccctggcctgcattcctgcatggcagtcatgattaggagctgagtagaggttgttccctttagctgggaccaatatacttcagtgtatcacagtccccatcactccctactatgttatgctcaggctcctctcatttatgctacttgtctagcttctatacgtacttgggtttgcaactcgactgagtaaaccaaataaaatcagagacacagtggtaagtggcctataagcattaattaagcttctgcctttcctcgatgttcactctgatatacttgggaattcagaattatttcacgtagaccttacacgaacagacgctaaagaaacagacttaaatgataaacttggctcatgtgcaaatgttacacagaaagccagtggcactccgtacagagaatagtatactcatgcctcatgtatgtgtgcagaacaatagatgttcatgaaatgcagatttagctgtgttccttggcctcatctcccatgactgtcatcgagggtgcccagtggatcagtaggtcacaagtgaacaagtgtttactgttagctgtgggtggccactcccacaaaaattcctgagaactggtctcatcctaacctcaggcccatgagctcagagaactggtctcatcctgacctcaggcccgtgagctcagcctcagcctgcagaaatgccagcttcattctttattttaattttcaagagataggctaaactcagaacttatgccacaataaattagaacaatccaacagaaacaagagaagagaggctgttaagctcaaggaaagaaaaaaaaatttataatgaggacatctgtacttatctggcttttctggagagttcaagttactatccacaaaacacatctatgaaaatgtttagaccacaaaacaatatattaatcagcaaataagcaaagtaataacaaattttatgcgttgaaagatgctattaaatacaaaggaaaactcatcatgaacttcccgttaaacatgcgcatacaacaagaattttattggaactttttgttggttggaattgtataaatccagtggagtatatttagaaagacaataattaactagaaaagagattgagcataaaagcgagaaaagcactgagtattccctgcccttcagctgaaggaacactccagcttcttcagctgattgctgaagctggccataattatcagaagtacctaagtggcttcttgacccttagttgcagaatggcataagaacaaaactgataaccattagaatgcatgacaaattgtacataatatctctacctgacagaatacttaaaacaacattttatcttaggttttaatggtttggggaaagagcatacggtatctacaaaattcaggacattcattagttaagcattcttgaaatctacaatgccagccactatccaagtaaggggagcctcttaagtcacatttagagctattttctttaaaaggcactttgatattagactctttaaacataaattttaaagtacagcttgaaagcgagtgataactactaggaaacaggatttttgaaggatatactataaattctgtagcataaggtttaaaaaagaacctcatctttgaacattttttaaagtgctgcacctttaaagacacaggtgcttttagttcacagtccaaaaatgagtgactgaatatactaatgtcaaagacaatgacaaaatcagagttctgaaaaatacacagctttcaattaatttgtgaacatgtgtgcatgtgtgtatgcatatctacaagtccctaagagatcaggagacgttatacacaggattgctgttatttctagccgctcctaagtccagatattagacatgcaaaaagacattcaggaaataaatggggcaaggaaagagatactgaagccctccctaaaatccaaagcagcagcctgtgtagatgtcttcactgtgaggtttccacggaagcacatcaccctactcagattatgcagtctcatcttcaagtgccgttaatcagaaacctgccagggagaatactaaactctttctaaagatatctggaatatcatcaagttttatcaccaaacaataaaacaaacccgtcaagtagattttaagatttatttctcctctactattaaggagaaaggagcctgttataaatgactaacattagtcacaaatctgcaggtcagcaaatggaaaaaattgaaataaccatacatgaatacgaaaagacagcttgttaattacttttaagaacgtaaattgtgttggcatagtgtacttatttatgaaatattgacaaaataagaaatattctacatcagaatactgagtaatgatggggcaaaacaaactagtggaattttcaattacattctctggggtctaacatttcccatcttatctttgcattctatcctcaactttctcatcctcaatatctgaccactataaggcagcttcagaagaagcaaagatacaaacttatttcaggaagttactttagaaagcaaagtgtatagggctgggtgcggtggctcatgtctgtaatccaagcactttggggggctgaggtgggtgaatcatgaggtcaggagtttgagaccagcctggccaacatggtgaaaccccatctctactaaaaatacaaaacattatcagggcatagtggtgagcagctgtaatcccagcaacttgggaggctgaggcaggagaatcggttgaacccaggaggtggaggttgcagtgagccaagattgtgccactgcactccagcccaggtgacagagtgagactctgtcttaacaaaacaaaagcgaagtgtaactctaccacaatgcccgaagctttcagggaaacctaggaagcctattgaagatcactaggaaccaccactagcaatgcgtctaaacttaaaaccaatgcagatactgtgtgttaggaaggaggggagagatagggaggaatgacatattggacacaatacctgggaacacatcatgagaaaatagtttgcaaactaattaattattgtataatcatgatccttagagtggtacaataagaaaagattaaaacattttaatatttaaaaccttaaaattcatccttataaaaactttgttgttaaatctacatgctatatttctaaggtaatacatgtagataatttttaaatggtaaaaacgtaccatattgggattaatgcttatttttttctggcccttgggggaatacatggttaaaacctggataactttttgtctagataaagcactcaaggaaatctggcttcattggatcaattactccactaaggtatctttttaatgttatcttattttcacaaacatacattatagaaaattttcaaattgcagagaaatataaaagaaatcgcctgcaactttatctctaaaaatattttggcacctcttatgcacccttaaaacatagtattttacatgtacttaagtatacttaagcataaaatttcgatattaatatactacagtggctgttttaaacccctttttaatatgaattattttgaaacacaatcttgtctggacactacaaatttgtttataagttatgtactaaaatttagccagctctttatagttgaatagtttcttctgaaatatttgctattttaaaataatgcctatgaatgtcttagtagcttctcctccatatttctataacttaatacatttttagaaaaggaattgctgaaagataagatatttgatatgttttataatgttgcttttcagaaaaatggtacaaaatttacccatgaatagcttacaggaatctcctgacgctcaccaacagtagacatcaacattaaaaactacagtgatttgtcaatttgattagtgaaagatatccagtacccaatttccagtgtttcctaactcctctggcccaatttactcagacatggagagctttggatgccaaagagacaagattcgattggtaagatatggtaagattttatcctgtgagacagtggttctcaaggaaatggtacaacattcctagggaatacctaggaaatttgggtaaatgtttcagattttcatgattttgagagggttgctactggcatttagtaggtggaaaccagaggtgtcagctgccctgcactgtgtagagcaatcttgagtgacattgaactgtgtcccatgttttacacaactttcaaatgtcctagtagaaatgtatgaggtaagaagcttggttataattattcaagcgcagaacctaactgtttaacataccaatgccaaatattttgtggccatttttaatagttttctactaccatgtaaagcaagggaaaaatgatttcttcagagtattcgcaaaagttcataatttttgaaaagtatatcattaataccacactgttgctgttttcatcactaacatcacctacttataatagtctgcattcatagactacattcactgtgtttctaagagtatatgcaagaatcttatcacttccttatgtattccaatactgtcatgctcaagtatttatataataaaacttttcttataaactttctctttcatattgtatataaagtcttatgttgccttttacaaaactgtatagggaggtcatgtatttcattggtttcattttaggagagtaaagggtatattattctcctaaatattatatttactataaatagtggtcattgactctgaccgggttgagaactgttgctatatgggactagggaacaggaagcaagtcagagacttccagcagaagagtgacatgaagaagcagagacggaggtaaagaggggcttgacggtaaagaaaataaactggaaaaggagatggcaggaggcagagagaccagaaaagagacaaatacaatctaggtagggaagtaatgaagacctaagatatcataatgagtgagagtcagaggaggattttacggagggcgtcttgaaaaagtgaagtcgttggaactcaggcatccagtatcacagtgtcattgcattgttaggctacagtgattgtgttctcaaatagtctcacgtacgtgcacatacttgcaagcatacatatgcgctcatacccttcaactctccagattcattaccaaataatccctctccccttctgccgccaaatggaagatttatcgcaccagcgattctgaaatgtgacagctcaacctgacgttagtctgaatcagaggggcaaagccttatttgatttgtgattctctatccaagataaaccctgaaataaatttcaagtgtgctttaagtacactacaggttataaatcatatacttgtattctcattctacagtaagcataaaacctcataaactatgtgatatataatctcccttcccccttgccaaattcatgcacacttcctgacttgcagggagagaatgataggaaattaagaaactcagaaccagtgataatttgtctgcagcatgcattttttctattcagtagcaactataacaaatgaagttgttactagatcaggcaaggggaaaccatggttgtaaatggcagaaaagcatttccaaaattaagggatggagagtccaagatggctgacagtaaaaaaaataaactggatatttactgtatgatcatccattttggcaaatattggggataagagaatgtcccaattcctgttcaattcccaattaagataaaaagtgcactacaggctgggtgcggtggctcacgcctgtaatcccaacaatttgggaggccgaggcaggtggatcacctgaggtcaaagcctggccaacatggtgaaaccccatctcgacaaaaatacaaaaattcagctaagcatgatggtgggtgcctgtgatcacagctactcgggagactagggatgtgggaatcgcttgaacccgagaggcggaggttgcagtgagcagagatcgtgccattgcaccccagcctgggcgacagcaagactccgtcttggaaaaaaaaaatgcattatattctgtatttgagattagcttatatatccatactcaatttcaatttctctaaaaacaaacatgagtctgtctagttattctaatccctgtcagtccaacagtactgagttagacacaaatatcacattcttcattgtttttcgtaaacaatttctagcttagtgagaaaaatggtgaccctatctttctcaacttgtaatttctttctctaccctactaaaaaatgtcagccacatcccatcatagtgaaaaaatgttcctctaaacttcaccactaaattctcacattgtccagttcctgtttctctttatgggttacttaacatctgaaatgtattcttaagcactttgctattttgtgtgtgacaaatacaagacaaatccccaaagtctatgctacctgcctgaaatggataagggcacagatataacaccatccatctctccacatctttgctccctgagagggtttgataagaggtgtattctgtattggtcatctattatgttacaggttaggaggtttgagccatgaataaacagaaaatgacctgaagctaaaaggacacgctgccaagtgaggcaatcagtgaccatgacttaaaggctatgttctgccctcttccttctagttagactggggcaaaaatcccaagctttctgccgtggaaggcaaggctcccatgaccctccctctgcctgttactcttctcacctcccatcactgcttctttgcacccctgtggtctttgaatcacattctcccctcttgagcctctgagttctcatgctgtgattcttcctggaatctgcttctttaaaattgtcccctgactgacatctgcttattgttaaaaactcagctctagtatcacacattggggtagataccctttctctctactttcactgcaaacagttaatctccattcaggtacttcttggttaccttgtgattgtctctttactcattgtctctaggaatattgagtttctcaagggcagagacacgtccttttgatgtttgtatttccagtgcatagtatagtggacactcagcaaatgtttgttgcttacctgagtagggagtcttttgttttttgtcttctaaggggaaaataggctatggacaatgaaaattgcttttaaaaaaaaaacgttttccccctgagggtaaggagaggggtttgcaagtcagagcttttactaaccagggtcataaagtcagctgtgctgacttgatcccactcaagaggtagggaattgcctgattttaatggtgctagcccataagaacttggactctacatgtcatggccacataatccccagtgaaactcccatgggttcactttcagtatgcattatgttcatgcatccagaaagtgggatcaagtagtgttactcacgagactccatagtgcttggaaatctggattagaggcaggattataactggcagggccatgctaggcgaggagtagatgagacacaagcagtccctggagcctggggcctctcctcacacggtatcatcagccccaacagctgtgtgtgaagacacttccaagcacattttgttcgatgatcagctgaaacccactgcttagcatctcttttcttttatgtaatccccttgggtgtaagacatagggcctttgttgaagacagtctcacgcttacaaaaagtatcagatttagacttctaacattatttccaagtaaggtggtacaacagtcagagatgcagtagcagagttgaaataaatagtcattcatcacacaactttaaccttgtgtcccatgaccagatgtcacttcctgaagtacactgtgagccagaacttctaccttacagacaacctaattgttttgggtgtgtgtcaaccatgttaatttgttaaatgtaaacaatgtctacaactgtttggcctgtcattactttttaacaaactagaagacacttctctagataattctgtgcttgctaggccctcttatttataggatcaacagataatgtacactgaatctacttcatcaaaaagaaaaataccatttacttattacttaccaaattaagttttgcccagaactcgggtccttcttccatctctctgaggctcggtggaatgtaccaaaagcaaatattggcatattcaggctgagaattagaaaaaatataaagttgttatcttaagatttatcttagaatgcaatgaaatacttttaaaactcttagctagtttcttcaagagttatcatgtgtataaaattttaacatcagaatcttatagagtaacaatcccttctgccttcttgataacatcctatttaaaaattttctactccatagcgtgcacctagcaggttctctttcatcttaaatgtgcaaagatcaggaaaaaacagtaaagtttgaagctgactcaacccagctctgatcgtcagttagtgcctgcttacatacatgctcagagatgccctggatcctctctctccaacactgatccttaagttatttgctataccatcataggcttccaataattcttcttaaggcagccaaagttggcccctacacctggcaaatgcaaaagctttgattacctgtgagatgataacagcgtgacctgcttgggcttcactaaccagcactactatgaccctagccaatactgcttttgaaaaaagaacatcaccttgactcccggctctcgaatatcagtaaaagtgcgaattagctaggggacctattcaaaatgtagattctcataggaactcaggttcctatgttcaaaatgtccaatgtctaagtccatcctagaaaaggctaaagaattggcattttatgaagcatgtcaagtgattctgaagcgggcagtttatgttctatcagaaactctcatctacactaagtaatcataacccagttatcttccctgccagtctgtttttctatcagacatgacttgcttaaacatgggactgtattgtaacaggctttagcccagcctttgtcacgcagacaaggctttgtcctcactggacaaaaacataggaaatgcgatgactactcaatgactaggagatctgggacattatgttgggggttcacaaattagacatatagaattgtattcaggaaagattgtgtcatatgcatcttcctcatttgatgcttcacactgacaatatttgaactgattttcattttctgccataaacagtttgtaataaccaatgttgcaacagttctcaataactgtcagaattatgctccagtatataaagtttcaaagcatttcatcaagaggaaagacccatcatctcatatcttaataaaaagtagtttaaaatgaaacactgtaattcaactcaattttcacaaacatctattgagactacagtcattcttacaaatctacacaatttatacctggatctctgaagtattgaaagtaatggcaaaaaccacaatgacttttgcagcaacctaatataatagatttatctaggatagactgtactgaactcccaaattctttgagcatttaatgtgaacacatttttcaaatgaagtaactatacctgactagaaagtagaagaaaaatatagtaattatctgtcactagattgtgttatgtcagttatcaatttattgcctctcagccagaaatctaccctttttgagtgtcctaaaataatgtaggtggactctgcagatatttctcccatgacatgtggtccaatcttagactttgtcagcagagggtgctggagagacactggagaaggaaggaatgctttcctggtgtggtgtgctcactttcatgggtctcctacagaatctgtggttcatttcagcagtactggtgaccagaaacataagtacacccccacccatctaccccagtagcttcccccagtacacccctttcaggtggcatcacgtggcatcacagcagacaggcagcaagtggagagcccataaatggcttttcctggcatactcccctcaggtggtttcaaaggagagagatgccagctaggcaccttgccttggatgacttctctggcactccttctaggtagcttgcagtgatttccaagttgtggcatggcccctgtagatggcttccctcagctcagcactccagactagatttctagtgagtaccaccaatgtaacatctcagtaaacttttctgctatcccatgagccaaggtcatactctctctgaagaggtctagacctcagtcctgggaagggatggactctcccttgggcgctctatctcagtgccaggtgtggtggctgctctctatatcagctactcctgttcatttttaggtttttcattctctatgaggcaatcctccattactccaatcccttgctaataattattgatattacactttcccactttaccatgcagttcttgtcttctgagtggactctaatatgtcaccaaatttgttattccctttcatttgcataggaacattacaaaacagtttacgatgttttatctattatgggttctatattttacaagttaggacttagatctgattccttttgcccaaacagaaacttactaaaaaatgcaaaaggtctatcactaagcacttttagaatggaatggcttcagtgctacaacatttgaaagcttataaagcccttctgacacttcacttcattggaagaaatttgatgtttcatttggaatatctttgctttggtcatttccaaaattaagagttgaaaaagtctttgaatttttgcaaaaatatatttgactttttcctgtctctgcctctgtagcttgtattttacataattcttaaagagacttcaaagcactaatgagtattttcagagtaaatcatttgtataccccttaattttaattgcctacatatgtgaaagtctgacttcttgggtgtcctgagaacacatttagtctatgttctaaaatccacaaaattaggaaggtatttacaggagtccaagtatctagtgaagggtacaaaaactctggagcagcaagtgcattgtcataatctttaaaaaattcatgataaaggagtaatgtgccattaaagaatgaatacattctataccggttttcaaacaaaaaacattctaaagttctttatcaatttcaggaagaattatttagcaaattttgagaccatttgggaaagaaattagtggtcactaaggtagcagctcacgttctctaaaactgagttatgtcaaaagaaattcatctcctttgctttacaatgtcattagatcagaataataggtaacaaaagctaaagctagcactattctgttttaataaatgtaaatgcagaatccagcacacagattcaaacaatcatgcaaatatagagtgaaggaaaagctggaatggtgaattttaattgacttcaagcttataggtgttaagattagactattgaaaaatttcaaaggcagcactggatagcaaaaaagcctaagttttggagttgcaaggatgtggctttgaatttcaacttcatcagatctttgggatgagtatcaaactttctgtttctgcttcctaaactataaaatgtagatgatgtctgccccacagggttggtttgatgattaaagagaaaacgtgttttcaaaatttagtaccgtgtctggcacacagcaagcactggtcagttagtgactattatttggggccataatggcaaaaagagatgtcttttaaagtggatgagtagctccattaaaatgtgcactagtgaggtacatcactatgttaatttcttggtactatatttgaagggaaacattaagaaataatgtccagcgaggggtaaccaagctgttcaaattaataagcaaagctttctatgttatagatattgactaggcatcaggacaagaaaatgacactttctgaacttggaatgaatagaggacagggtgtactgaagagaggtgaagctagaaacgaagatgggagtcatgtcatgaaggacttctcgtatgatgtacttggaagcttgggcttgattctagaggaacatggagtcactggagagtttcactataggaaatagatctcatctttgaaaagctgctctagcagcagtgtggcagttaggctggagggatctaagactggaagtgggacacaagttagcagacagtacctagatagtaccaacctgaagagtgatgagatcttgaactaaggcagtggctttgggagtggagaagactaagcattcaagatatacttagcggggaagaaaaggagatagtaaaaacatcaagatttttggttagtggatcatagttctaatgaccaaaagaagaaagtagaattttggtaaggaaaatactacacttaagtttttagaaatgttgaatttgaggtgtctgtggcatctaggtgaaaatttcaggaaatattcatatacaaaggcctggagtttaggagctaagttgaggatgaagacatacaaagaggctattgataacaaagttctgaatgtgaagacatttcagggagactgtggccaaagacaaagtgttagaagaatatttaagggagtgccctgatgaaaagtcccttacatggagactgaaaagaacaagtcacatggaaaagagaaattgggaaaggaaatcaaagaaactaagacaggggagactatcaagagatggagtgatgaatgggtaacatacaatgctacagaatttcagcaagatgaagattaaaataatgtgctttggatttagcaattaggaggtagttatatagttttattagattacaagataacaatgtaagaaaaatcacaatgtgcttgatacatattagtaggttcactattagaacatgaataattagagctatctggaagaggaatgaactagtgaattctctgcaaataggaagtattcaatcacaggttgaccacctgttaacagatacattaagacaggtttgctgcattgtgcaggaagttgactatatgtcctcgaagatcttctataactcagttgatgaaacattaataactcctcctagtgtagaccttgagaaaagaaaaagttgaataattaggactctcccaagagataaaaaataaaatatgtgaattgacagtgtaagaatgaatatacctctaggaaaacatctattagatcttagatccaacacagaaaaatagagatgattttcaggggcctatgaataattcagaattcacttaaaataatacatttcttgaagatgattgaaagttatttttattctttccaggaaaaaatactcaagtactgggtattgtcttgttatgttcacttacaatttccaatgttccactttctccttgctgttagacaacagtgacacatactctctcaaatacatgtacatatacatatatagacatacaaatgcatataagcaaaaagactatcaactttatatgtgacattcagggtctaattctgctttattctcagtgtaataaaaagaaaagcggcaaatgcagatcacatacaaaaatccttacaccaggaattctggaaaaccatttagaaaaccacctgcactgcttgtgggccagctggctcccacagatgaaaaaatccaggggcagaaggctgactaaaatcccaccttagctttcattgcaaggacatgagtgtttgcaatttcctaatgacgatggtaagtggtttttcttttctaagactttaggaagaatatataaagaactttttaatcggcccatcttttttctcatcacttccagctctgtcaaaagactgtacagtttcaaggtgtataggacttttcataagcactatagctcccaacaccagagaaaataacacaactcaaattgagaaaatagaggaaactcaaacccgagaaaatataaagtgatcaaactcaattcaaataggactgctgtttctcccatacatgcttagctatccaccactaaaaactatagacattttcttacatgtttataatgccattatgcctcacaaaattgacaattccttgacaccatctaatagccagttcatattcaaaactccccaactgttacaagaattactttttacagttggcttgttcaaactgggatttcaacaaggtccatatgccttatttggttatgcctcttcggtctctttgaacctaaagagattatcactactccctctgttttcctcacatcaccggcctgttgaaagaaaccaggttgttctgcagaacttctcgcactctaaatttgttgtctttatagtactaccagaaagttgtttaatttttaatcattttggtatgcatgcaagatcttccatatgtctagctttctagcactttggaagcttagaactttctagtctgatgcttcctttgtagatactaggggaatccatgctctagattctctggaaagtatttcccaaacttccctgaggactattgtcatatttcactttggctactaaaaacagtttccaagtttgtcttgcttatttttctcttgtcctcttcactattgctttttcaacattcctctcttctcatgacatcaagaataatcttttaacatgcaagtcagactcctgtcttcttaaaacatctccagtgactacattcgggatacaggctaaaggcctcaccttgacttacctgaccaccacctgctctggtctctgcccacctctgcaattccatcacctgctgcacactccccttcattcaatacaactttttttggctgctcaaagacagaactctcttcagctttaagccttgcagttgtttaccaattctgccagaatatctgtccctcaaacatccgcatggcttgctgtttatctttattcaggtctcagctcaaagataaccttaaaatcccctacccagattactcaaaccaaataagccgtccccatttcagcattctacacttttccccccagtacagtactatatctataacctgtctaattatttgtatactagattatctcatgaacatgttttattgttttaagactacctgatttccctgttaattaatttgcttaattagtgcctttcagtttccacttgaatgtaaacatgaaattgggggaccttttctgttttctatctcctgtgcctagaaccatgcatgacatagtaattgttcaatgcatcttattgaataaataccaaaaaagctagatttctttttctttttttttttttccccccgagacagagtttcactcttgttgcccaggctggagtgcaatggcgcgatagctcaccgcaaccaccgcctcccaggtttaagcaattctcctgcctcagcctcccgagtagctgggattacaagcatgagccaccacgctcgactaatttttgtatttttagtagagacagggtttcaccatgttaggctggtctcgaactcctcaccttgtgatgcctgccttggcctctcaaagtgctggaattacaggcgtgagccactgtgcctagccagctacatttcttatgtatagcacaggttccaagactggaatctctaggttatttttacattaggttaaaaactgctataatacatatactataacaaaatctaagaagtttgcaatttatatttcttaaaaaccagaattacacattaaatatttatattttctaaacatgttttagaaaaaaatattctctacatttgtaaccacctaatttcttacacatagcaaacaatccaacatcagcaaaatgacttattttcccattgctccaaagctaatatgctcattattttataaaaagagaaaactgtatgcagtactgtacattcacttaattgatttttcacatgcaggcaccactacatcacagatgaatatttgcagtacaatcatgcaatttatataccaagatagaggtcataatttattcaatattatccttggtaattattattgagcattttaattttcaatacttaaaggcaagtatattctgtgaatccaacaaaggaaaagtactcactaatagagtaaattaacataatagactatgaattaagctaatgacttgtttttaactctgcaacacaaaaaccaatgaaacatataacagataagaaaattaccaccttcatcactgttaactgacaaaatcacaagcacaattatgcaatcacttacttccatcagtaacttgaatccttctcttttcttgatttcatctactaggtacctaaaattaaaagtcacaataatatttataatctgcaatgtaaaagtgtcatgaacatgactgatatgacaaaactgattcagacagggcttggagataagaaagatacagataaaggtcaaggaacaggcagagctatggatagataaatactccagacctactgtaatttccttggcctgagtaaaaggatgcatctttttgatgatgatatctatctcacatgttagcatcaggctttaaccctggtgtgaaaagccagataaagcaggctggatatatatctctgaacatgtgggtcttacattcatactgtaaatgggggatttaaccataggtacttacattaaatagctggcttggaggaaagagttttttgttttgttttgttttgtttttggtgtctaatcctgcttgtaagttcacttaaaatcaagaaagatcaacataatcttttctaagtccagcacagagaggaggactgataatcagtatcatgttaaaagtaggctgattatcctcagcaaactaacacagaaacagaaaaccaaacactgcatgttcttgcttataagtgggagctgaacagtgagaacacatggacacagggaggggagcaacacacactagggcctgtcaggggaggatgaggggagagtattagggaaaagagctaatgcatgtggggcttaatacctgggtggtgggttaagtgcagccaaccgtggtacatgtttacctaggtaacctgcacatcctgcgcatgtaccccaaaacttaaaaaatacaagaaaaaaaattacctgaatatgaggggaaaaaagtgggctgtagccattgatataatatctataaagtcattttgaatgttgggggaaagagaattgtcacacctaagtaaagggcatagatgaaatatggaatatgagtgagaaaagactaaaacaacattgagaacatggtgccctatataatattgactcctctcttctaggcttggcttttgtctgtaccaaaagagaagtctgaaatggctggccttgaaaactagtgattcacgagcctttgaaatattcacaacacttgacccagtacttcaaatctaggactcaaacataaggaaataatagagacgctgacagaaatgtgtttgtcagagcatttattgtgatttttatatataatagcaaaaaatcacaccgaacatcaggaatgcctttgaaaactagattccagtaatagttatgatcctatgatcatgtcactaaatcataaatattcaactaatatttaaagacacaaccatgctcctcttgggcctcaagtctcttacctgtaaaactggactaatacaatcttcttcaatttgaaatggttttttaaaataataaacataaatgcagactataaaaactggaaagggattattacgtcattttaggaaggccattctataatgtgaatatggaatacactagtttttaagatgttcctttttgcaaatttatacagctttttatattaaaatattgatgtttgtatatttcaaagatattatctatatgcaattgtattaaaaattgtcaatattaactagtaatatgggaatccttgagcgataacgtgagcatacacatgggcacgtatgctcacaaagtaccagatgttctacatatgccattctctgaacactttttcagaagacatgtagctataaagtttttaaaccatctatcacactggctagctttcataaaaagcaattccattgctcaacagatatcagaaaagttattcaaaatcagtaataatcaaagaagtgcaaattaaaacaatataggcatccctcgggggtattgtaggtttggttccagaacactacaataaagtgaatgctgcaggaaagttcctcagtgtatataaaggttacatttacagtatactgtagtctgagtttacaatggcattatgtctaaaacacaatgcacatgccgtgactaaaaataccttattgctaaaaagcgctaaggattatctgagacttcagtgagttgtaatctttttgctgctggagggtcttgccttgatgttggttgctgactgatcaaaaggctgaaggtcggggtggctgggacaatttcttacaataaggcaacaatgaagtttgccacattgcctgactctgctttcacaaaagatttctctgtagtaggcaatgctgtttgaaagcatcttacccacaacagaacttctttcaaaattagtcaatcctttcaaaccttgctgctgctttgccaactaagtttatgtaatattctatatcctttgttatcctttcaacaatattcacaacatgctcactgagtagatttcttctcatgaaaccactttctttgctcatccataggaagaggctcctcatccattcaagttttatcatgagactgcagcaattcagtcacatctttgggcttcatttctaattctatttctcttgctgttttcaccacatcttcagtgacttccttccctgaagtcttatacccctaaaagtcaaccatgagagttggaattaacttattctaaatccccattattagtattttgagctcctatgagtcatcagtgttttcagtggtgtataaaagggtaaacccataaaattttcaattcactttgcccagatctatcagaggaatcactgatatcacggctatagccttacaaaacacatttcttaaataagacttgaaagtctaaattactccttgatccatgagctgtaaaatgaatgttgtgttagcaagcatggaaacaatattaatctccttgtacatctccatcagagctcttgagttactaggtgcgttgtcaatgagcagtaatattttgaaaagaatctttttttctgagcagtaagtctcaagtctcaacagtgggcttcaaatattcagtaaaccatgccataaagagatgtgctgtcacaggctttgttccacttagagtacaggcagagtaagtttagcgtaaatctgaagagtcttagaattttcagaatggtaaatgagcattgacttcaacctaaagtcaccagctgcattagctcctaacaatagattcagcctgtctttgaagctttgaagacgggcattgacttccctctggtcatgaaactcataggtggcagcttcttccaatataagactgatttgcctacattgaaaacctgtttaatgtagccacattcttcagtgatcttagctagatcttcagcataacttgctcagtttctccatgagcatttgctgcttcaacttgcacttttatgttatgagacagcttctgcactcgaacctcatgaaccaacctctgctagcttccaactttccttattcatcttccacacctctctcagccttcatagaactggagaaagttagggtcttgctctgaattgggctttggcttaaggcaatgtcatgcctgctttgatctatccagaactctacaaccttcatagcagcaataaagttgtttcgctttcttattattcatgtattcactaaagtagaacctctaatttccctcaagaacttttcctttgcattcataacttggctatttggcaaaagaggcctaactttgtctgtcttggcttttggcatgccatcctcactaagctttaaccatttctagattatttgaagtgacagacatgtgactcttcctttcatttgaacactcaggccattgtagagttattagttggcctaattttgatattgctgtgtctcaggaaattggaaagcctgaagaggagagagatgggaatggccagttggacagcagtcagaacacactcaatattaagttttccagcttctatgggtgcattctatggagccccagaacaatttacaacagtaacatcaaacagaactgatgactcaaacatttttattatgagaattaccaaaacataacacagacatatgaagtgagcacatgctgttgggaaaatggcacttgatagacttgctccatgcaggattaccacaagccctcaatttgtaaaaacaacaaaacccccaaaacacaatatctggaaaataaggttaagcacataaaatgaagtatttcctgtattaaccatgtttcccaatgataccagaaataaattttagagtgacaacatccagtggtggtaagaatatgatagaaagttgctataaaccttttaagtaatactcatatcttatcaagcaaaccagttttgaaatgctggtctacaaagaaaaaagttatcaatatcaaggatagatataacagcatatatgtgcacatatatttatatgtactatctaaatgtctgtactgtgggtatataggtatattccatacaaaataactagaaacaagattaatattcataagtagggaattaaaatgcggactatagcaacataatgtaatatgcagctattaaaatgaatgaattatatccacttaaagcacaggatgatcatgataaattagtaaaagataaaagtgaggttctgagaaatggggatgatttgattcaatttttacactttttttttttaaatctcta

SEQ ID NO: 32 - DNA, 11270 bp, Homo sapiens
gctctaattgagtcaaggggattaagacatttcaagttgtatcaatccatttctagttggattagataagcatgaaccaggcaagctggctctgatcagctagaatgagacaaattgaattctaaacagtttaattggaatcaagctttatcaatctaagttaatttctgtgctgcctgggaaacaaaacattgctttaagaactggtgtcactccatgcttgtgtcatggtggcaaaaacgatgagttgcttgccagtgtccattctcatagttttcttcactactagtggaactacttatgtggttgtggtcatcaatgtgtctagctaaaacaaagcaaaaaacaaacaaaaacctacattttctcatctctcctgaagagaaatatggcaaatggagtgggcattgaaaaataagttcttttctatttcttgtgcctgaattgtggaaaaaaatggctggaactacagagttgcaaccatgggtaaaacatggtgacttaattcatctctaaggatggcacaataaaaatatataaggatcctgggtaacatggtaaaggtaccatctcctgtttccaaagtggtcagtgctccttccaaatctcctaggcactcaccagtcctgctgaagactttaccttcaagcatctgtactctctgtccaaaggattactagggccatagggggagcatggtgggggactgtcagggagctaatgcccctgggatcagtttcaaccaatttatcaaccaatggattaacacctgttcttccccagccctcagatgggacatctccaaggtatattttataccctttcgccgatgtcatgggtaggatcaagcctcagttgctcagagcattaatttgctcactaataatcactactgattctcttccctttcctgtctcactgtaccactcccaaaacagtgtttcctggcatcaccaaatgaataggatacttgctctcaaatccttgtctcatgcctgcctatgaggtaaccaaatataagaccatctctggattgtctatcttggaacttcttttgaataaagaaacataagcctctttaatcaaatcacaattatttgagtattctgtaatatgctgctaaaccctttcttatctgatctgattagcaatgtaataatttcttaagcttaaatctctttattattagtagtcctttttccaatgaagaaaaactattaaaaaccaaaagccagaagaagaatttaaaagccttttgatttaataaaatctgatgcctactaaaataaatattgaaaattatattctaaatgtttacttttagcaaatacaatttcaacaagtaaatggctttacattgccaactagtaaatttcagttcttacttgactcatccatagcttttgatagagttggtcctttcctcctttctgaaaaatgtttctctaattggtctgtaggcaaccaccctctcttggctttccttctgcctcactggctgcttctttccagtctcctttgctggtttcccctcatctcaagctggtattcttaggctcaatctttggcctgtgtctcctttttatcaacaagcatgctctacatgatatcatttgatcccataatttgaaatagtatccctaggttgatagatcttaaatttacatcttcaatcccaatttctcccctgaagttgagactcataattattacttatataccatctgtggttggctggtttttagacagctcagtttttacatggctgaaaccaggcaaaaccactgttcctgcaatcttcaactcagtaaatggcaactcctttataatggttgcccgggccaaaagcatacgaaactagccacaattcctcatttcgctttcaacactccacaccagtagccaaccctatcaactccacctttaaatgcttccagaatctgaccccttttcaccatacctccactaaaatggtaatataaactaccacaatttcttgcttgaactctttcaattgcttcctattttagttctctgagtctactcttgccccacgcacacccaattctctaagcagtaatcagtgtgatcttgattcaaatataaatggaattacatcaataccctgtccaaattttccagtgtatatccatctaactctaagtcttcacctacagaacccagtgtagctcactcccagacacttttttacttcatcattcaccactcactctgtcattcacttggcttcagccagactcacctccatgttgatccttggacacataccatgaatccaactcctcaggcgtctgacttatcataccctctatctagaagatcttctaatcagctacccttgtgcctctctccctcacttcctggaagtctccattcaaatattacctcaacagaggccatgactaaccaacttttctaccatagcacggcccaccacactctcccttccatgctctatctttttactctgtttttcttcagaatatttattgccacctgacatgttatatatttatgtgtcatctgtctccattaggatgaaaatgttagaagagaaaggactttgtctattttattccctgaatatttctagtacctagataattgcctagaacatagcaggcacactataaatgttttaatgaaagaataaatgcattataatcatacttttatcaaaaaattatttttgaccacttagtcaaatacctgattgagtgtggtatgtctgaatatttcaagaaaaaataatgaaattttcaaaatttctggcagcagttttttttttacattgatcaaggagctgccctctctcgtaaaaaggcacagcaggagttgaactgtggctgagatacccatggcttacccagtaattgagaaagactaaacaagagagtccactctttgctataactgctttttccattttattcaaggtgttaactaaaatacagagagctttcaacctactttttcagtcattaaactaaaatgccaaccaagtccagttcacttctaaaatgtattggtacaatccagtaaagaggagatgacaggaaaagaaaagtcaacaacactaagtatagtaatgttcctttttgtttcatgaaacccaaattgttacaaacatcaattttagaaatattttatgtagacattaaaacaaaaaggcaacaagaaatgcaaaataaacacacacacacacacacacacaccaataggtttcacctgagaatttgaagtaattcagagacagatttaatattctttgaccaatagagataccgagaaactgtgcacactaaaatgaaaataagcaataaaagcaaatagtactcaaaatttaaatgacattggttaacaatggagtacgaaaaggttattgaatgtgctaagtctaatgctttaacactcttcaatcattcaccttttaatgcagacctttaattatattcataatcttatcttggtgaactctacacccacacctatgaattctgtcaatttcttagttaaacaaaactctcctagaaacctaggaccagggtcagagatagaattaaaatcacccactctcaggagaaatggaggaagcatttacactgaaagtctgctgaatcccagattctgtaatataaaccacttaataatctatactgacatttcaaagcttaggaaagggaatgttgtacaaccctggacttcattgtgtttattccctatgaggcacagagcaagataataaacaagcccctcaagctaaaagaggaacacagaaacatatatgtgtgtatatatatatatactatacacacacatatgtatgtgtgtgtatatatatacatatatatgtatatatgtatatcacagaaacatatatatttcccaaatttttcttaaaaagcaccccagttcaggtatcttgaataaagaaaattagtcatagacgaaaaaaaagaaaaccttccagttgtctaccaagaaaaaactaatatggatattacatgcatttctattttgaagaccaacagtttattaatttattaatagaacctgtatttttctgtcaattattgtgctttcaattattgtgctttgaattatatatatatatatatgtgtgtgtgtgtatatatatatatatatataattttaacttttgagaatggataattttaacttttgagataaacattcagcctgcataaaacataaatctctatgaagtaaacatcttatacagtttctctctttaaaaatagctttgacatgcttctgatgtccttaaatatttgtgctgcagatgccatagttgtattttttcaaagactggctcagaggcttctgaaatattagatatccctttgctggcaaaacatcagagtgggtattcgatcattacaaggtttttcttaaaccagtgtttctcggattttactgtgcatcagaattccctgacgggcttgttaaaacacagaatactgggcctcacccccagagcttctgatccagttggtctagagaaagcctgagaatctgcatttttagcaagttcccaggtgatgctttgatgctgatagtccagggaccacactttgagaaccactgctttaaaccgttagtttataagttctttaaagagcaatgtaagcttagaatccagaacctacatggtacttactaaactctcttcagagctgtgttccaggggcattccttgagaaaatcatttttttttttaaactttcttcttttagcaacagtaatgcccaggcagctagagagtccttaatattcattgcttagcattttggttttgctgggcctggactgggagtattccctatttctcatcagaagggctgcaatctactgtgtatctccaagatgttctggatctaaactctcccaggataggatctatgcctctgggggaccaaagccacagctacatgtctttacccagtaagtctatctcatccaggaggaagtccatgtcctcccggctcacttgagggctgatcaccacctggcggaagaagttgacctttccccggtgcggctggtagcccagcatcaagcttcccttcttcatcatcctctccttaatggctggggccacctgtgtggggagaaaaggggagaggggtgaaagaccagaacatcaaggcatttcaatagcattttcaccagccattggacatttactgggcatccactggtttggatcccattctcattcacacaaggttgacactaataataataataatttatggaggactcatgagtactgattcaagtgctttagacatattaattaatcttcacaataacagtgaggaagatgctactaatgtgcccatttatggtcgagaaaacaggtacatggcgagtaaatcagtatctcaaggtcccaggcattttctccctaagcccatactcttaagtgtaaatcattattcaatgctgcctcattaaaaacaaatcaggtgtccacagggattacagtctcattctcaaatttgtcttaactaaaaaacaccccagttcaggtatcttgaataaagaaaattagtcatagatggaaaagaaggaaacccttccagttgtctaccaagaaaaaacaaatatggatattatgtacagttctattttgaagcctaagtttattaatttattaatagaacatgtatttttcatcctagaaaaaaagaaagttagatattattctcatatatgaaatataaacaccctgtctcttattaagagatgtaaatgtggtaataaaattaggaagcacatattttaaagatctatagctgacatgagaagtacaggccctgataatccagatacacagatttttctaaaagtttaatgtttgaagaaactagtctaatttaagaaccacatgggaaaatcagtccattttctaatcagtagtatggccaccaaagagctaggttgtaaacttttaaaatagtgaagttcatttttgatacactgagttaaaatattaagaatgcatttttactgtcttggaaatacaagcaaagtttttccacttgaattttattttaactctgaaaactttttgagtgtgtcctatgtgaatatgtggaaagggaatataatgagtttctatccttgccttctcaggaagatgagacttactcctccagaagggaggagtacatatagaaagaacaccaggcagagtgtgcttttaaactccttaggtgaggggcatgaatctgggttcccacgagtctccctctctcgtaatgtgataatcccacaccagcccagtttttgaacatacccacattttgtcagcaagtcaaatgacttcatctgacactcaacacaatcttgatctgttccaaagctgatgaaaaaattgggtgttttagacctctgaagatattatgtgttgaacttaaccacagagccttctcaaaggatgttcaaggttaattttaactcaacacttttttttccacatgtactaattttagaatataagtcttgcaaaacatggactacacagtgcttgcaataacaaaacaaacacctattcaggaaaatcacattgccattctagcaaaaaactggaagtttcttacattatcacaagatatgaaaagaaaatatatgagtgtaaaagaaaaaatgtagaaaaggtgatgttagaggtcaagttagtgaaaaaagcatgggccatcaggttctacaaacttctaaatatatgtgacacattttattctgagctttctagagattagaaaaatgtaactaaacaacagcctgcattcacttgaaaagagtggcaaatgtccagttgatgctggaagccagaagctaggaagtaactctctactatgcttatacatatctgcttcaaacccatgaatttgtatgcattggttgagttttcttccaaatccatgtatgcaagtagtaattctaaaatctagtaaaaaaatatgtaaaacaaagatagatgagtgccaaaaaaagtgatttttgtaaaaactaagttgagtcctttggaaagaagagataaagggggatggctaaacatcattgtgatcacactaggcaagagaactgtaaaagcttttgagaatccagactgattctgcacggagatcgctacacaggtgtctgagtacttacttcacctgaagaaacccgagctgcataagacagatgattcctgaagaatgtagtttatgcaagaacagtggagggccctctcatcatcagacctctacttaagaaaagtttcacttgtttataaaaagcatttggaaatcttcactaggtggaaaaaacctttccatcaaaagatggtaacataaatgtacactgatatacaaatataacattaaaaatttaaatataaagatacaaatattaaatgggaaaatgctcacattatgtatgtatcacattattttctagaattatttgctttacctgactaatcctcctcaccttaggtaggagggcttctcgtgcatatgtggatataaatgggtctgcgtgcataagcatgtgtgtgtgtgtgtgcctgtgcatatatgcacatgttaatatacacactcacatataatttaaacctctgacccaccatattgtactgcttttaaaatctctctggccacagggcaatggagaaccacgctttgacttaggttcatcataaaagtacacttgtttttaattcaaagaacaagtggctttctgaatgcaaactgtgagaaaaagacaacagtagtgccagtgctgaatcaagattgggaagacctggtttacatggaccaaatgtctagctagaagggccacagactatcagttttagagcttacagcttgcggttctgtggttcttgtttttgaaatcaaaattctcttcatgttcctctccttcgtcctccaggtacccagggtataactggctctggcttgtagccaattttaaatgtaaaacaggcatgctcttggctcaggcctaatttgcatagtgtattcctgtttacttttcaatacttccattttttctcccaaaatggtattttatgccttatctttggagagcattagaattttgattccagtacataatatatctgaggctcacatgaggcaattatcaaaatgaatctgtcacgtttgtatttcttgtgaggaagccagaaatactttctaacgtgaacaagaaaggtaaaggaagagggcacctcagatgttttaatataaagatactttggatgtttaaattcttgctcttgtgtaaagcgcatgactgtacttccatgggcaaaacgcagggaataaaaaccaaacttctaggacaaattttgttactgactttctgagattataaagacataactaaatatatgactcagagaactagctaagcaagggtttaacagtacaacacatttttatttatgagtctatgaactataagattaattcctacaggcagttactactaggtaaaaaaggaaggtctcccttgtctatgaatacttcgcgggaaagaaagtaataacatcaaagctgatattcatcaaatctttatcacaaactattctgctggtagtagtagttgttgtttttaacaagtattttaccagttctttacaatttgcaatgtcctctcacttgtctgattcccataaattcaaattaaagcttatttgaaaggaattcatgttttggcaatttagggaccaagcacgttctcactaacagtcagcttatcacctttgcacttaaaatcaaccattttttatttatgaagctccaggcataatccaatgctaggtaatttggatattcctttttgctgatcacagcagagacagtcctaatctgacaggatggcatggtcacaggggaaggaaaatatgcatgaactaaatgtaggtatccagataccacccctaaatggggcgcgcatagaggaaagcaatttggcaggagtgagattgctttccagctctcaattatttttctgctgttttttcttcaaattgtaaatcaaattcttttcttgtgcctcagtgcactggtccctgcatcttaagtggaggaagattctgacatttctatttggatacacggtgacttaatgtacacatttctgtggaatttgtctctccctacccctgagttatgttccatcagtgatttagtcatttaaatagagtctcgttgcacatcgctgtagcaccaaataggatttgatatttaaaagttgcttaaacccaaggaaaaataaaataaaatgactttctttctgaccaagcagggcaattcgataaaaagcttctgaccaggcatcattattgcctttgattaaaataaaatgataatttccataaaatgacatttctttttaagaatttgttatatactcagtgttaacaagaacagtttttcaaaatacaaagtgtttttcagggtcgggcatggttgctcacgcctgtaatctcagtactttgggacgccaaggcgggcagatcacttgaggccaggagtttgagaccagcctgagcaaaatggtgaaatctgtctctactaaaaatacaaaaattagctgggtgaggtgctgcttctttgtaatcccaactactagggaggctgcggcacgggacgcaggggttgtggtgagccaagatcactccactgcattccaacccgggtgatggagtgagactctgtcttaaaaaaaagtaataaaatacaaagtgtttttcaaactatctgtggggaaggatcagttttatttttttcaatgcattataaactaatactttagtaaaatacaataaaaatcaattactagcaaaatgaaataaaaatacaagcccaattttgtttatttttaagttcaatagtaaagctaatctgttaaggttgctataaaagtttctaaatggaaactgtggatttccataaatttcttattgcagactggtgacacagatgggttgggattgctgctgtggctttcttccagtatagtttttctggaacaatcacaaaaactaatttgctttatactttcctcccacgtaatctgggttcccaatgtgtcccactttctatgtcaacttgaggagagttctgctgagtgggatattgaaatctagttcatggaaaaaattggcatgaaatgttcatactttgtatctggcacccaaaactatcactgagacttacatacctccctcccctgtaaagtcatctcttttcttttcttttccttttctccttccttccttccttccttccttccttccttccttccttccttccttcctccttccctccctccctccttccctctctccctctcttgattgcttgcttgctttctcttctttctttctttttttgtagtttggggtcatcttagattttctgaagccaggtggagatacaccacggatcaaggcaggggccagaattcagggcatgaacagcatcaaggggagagcttaagtggaaggatttcagtccaagagaagtattaacatgtcaagacaattcagactttgatgggctttccccgtgcctcccccttctgagggggtgctccaatgcagtggctatctagaaggcagagtttttcctgtctcactgtactcaggagaaattagccacagtcctcaaaagctgaaggctgattaaccatctgagaaaagccaacctagagagtcttgaatgccagcttctgcagatgtgaaaagttagacatgtgagaaagcatgaaattcttttatttgctttattaatttttctggtatttatctccataactaaagcattatggttgccagtgaatttaaggtcttcagaaccatgttagatcacaaagtctcacatcgatttacatctctgtttgccttttagtttcaatttttgtttaagtatattcttcagtggaaagtggatttcatctgtttctggtgatgaaagagctcaacaatatgtctcatacaaatacttcttaaaacctaatgaatattcttatctctgaactacatatctgaccataaatatgaactgaattattctgcctgtaaatatgaactggattttcctttacacgtgcagctcacaacatgtagagctgaaatgggctttggattcagctaaatatatatcctctagtgtgtaacctccatgttagccaggcaggttgttactaaatgaacagctgtt

SEQ ID NO: 33 - DNA, 8658 bp, Homo sapiens
gctctaattgagtcaaggggattaagacatttcaagttgtatcaatccatttctagttggattagataagcatgaaccaggcaagctggctctgatcagctagaatgagacaaattgaattctaaacagtttaattggaatcaagctttatcaatctaagttaatttctgtgctgcctgggaaacaaaacattgctttaagaactggtgtcactccatgcttgtgtcatggtggcaaaaacgatgagttgcttgccagtgtccattctcatagttttcttcactactagtggaactacttatgtggttgtggtcatcaatgtgtctagctaaaacaaagcaaaaaacaaacaaaaacctacattttctcatctctcctgaagagaaatatggcaaatggagtgggcattgaaaaataagttcttttctatttcttgtgcctgaattgtggaaaaaaatggctggaactacagagttgcaaccatgggtaaaacatggtgacttaattcatctctaaggatggcacaataaaaatatataaggatcctgggtaacatggtaaaggtaccatctcctgtttccaaagtggtcagtgctccttccaaatctcctaggcactcaccagtcctgctgaagactttaccttcaagcatctgtactctctgtccaaaggattactagggccatagggggagcatggtgggggactgtcagggagctaatgcccctgggatcagtttcaaccaatttatcaaccaatggattaacacctgttcttccccagccctcagatgggacatctccaaggtatattttataccctttcgccgatgtcatgggtaggatcaagcctcagttgctcagagcattaatttgctcactaataatcactactgattctcttccctttcctgtctcactgtaccactcccaaaacagtgtttcctggcatcaccaaatgaataggatacttgctctcaaatccttgtctcatgcctgcctatgaggtaaccaaatataagaccatctctggattgtctatcttggaacttcttttgaataaagaaacataagcctctttaatcaaatcacaattatttgagtattctgtaatatgctgctaaaccctttcttatctgatctgattagcaatgtaataatttcttaagcttaaatctctttattattagtagtcctttttccaatgaagaaaaactattaaaaaccaaaagccagaagaagaatttaaaagccttttgatttaataaaatctgatgcctactaaaataaatattgaaaattatattctaaatgtttacttttagcaaatacaatttcaacaagtaaatggctttacattgccaactagtaaatttcagttcttacttgactcatccatagcttttgatagagttggtcctttcctcctttctgaaaaatgtttctctaattggtctgtaggcaaccaccctctcttggctttccttctgcctcactggctgcttctttccagtctcctttgctggtttcccctcatctcaagctggtattcttaggctcaatctttggcctgtgtctcctttttatcaacaagcatgctctacatgatatcatttgatcccataatttgaaatagtatccctaggttgatagatcttaaatttacatcttcaatcccaatttctcccctgaagttgagactcataattattacttatataccatctgtggttggctggtttttagacagctcagtttttacatggctgaaaccaggcaaaaccactgttcctgcaatcttcaactcagtaaatggcaactcctttataatggttgcccgggccaaaagcatacgaaactagccacaattcctcatttcgctttcaacactccacaccagtagccaaccctatcaactccacctttaaatgcttccagaatctgaccccttttcaccatacctccactaaaatggtaatataaactaccacaatttcttgcttgaactctttcaattgcttcctattttagttctctgagtctactcttgccccacgcacacccaattctctaagcagtaatcagtgtgatcttgattcaaatataaatggaattacatcaataccctgtccaaattttccagtgtatatccatctaactctaagtcttcacctacagaacccagtgtagctcactcccagacacttttttacttcatcattcaccactcactctgtcattcacttggcttcagccagactcacctccatgttgatccttggacacataccatgaatccaactcctcaggcgtctgacttatcataccctctatctagaagatcttctaatcagctacccttgtgcctctctccctcacttcctggaagtctccattcaaatattacctcaacagaggccatgactaaccaacttttctaccatagcacggcccaccacactctcccttccatgctctatctttttactctgtttttcttcagaatatttattgccacctgacatgttatatatttatgtgtcatctgtctccattaggatgaaaatgttagaagagaaaggactttgtctattttattccctgaatatttctagtacctagataattgcctagaacatagcaggcacactataaatgttttaatgaaagaataaatgcattataatcatacttttatcaaaaaattatttttgaccacttagtcaaatacctgattgagtgtggtatgtctgaatatttcaagaaaaaataatgaaattttcaaaatttctggcagcagttttttttttacattgatcaaggagctgccctctctcgtaaaaaggcacagcaggagttgaactgtggctgagatacccatggcttacccagtaattgagaaagactaaacaagagagtccactctttgctataactgctttttccattttattcaaggtgttaactaaaatacagagagctttcaacctactttttcagtcattaaactaaaatgccaaccaagtccagttcacttctaaaatgtattggtacaatccagtaaagaggagatgacaggaaaagaaaagtcaacaacactaagtatagtaatgttcctttttgtttcatgaaacccaaattgttacaaacatcaattttagaaatattttatgtagacattaaaacaaaaaggcaacaagaaatgcaaaataaacacacacacacacacacacacaccaataggtttcacctgagaatttgaagtaattcagagacagatttaatattctttgaccaatagagataccgagaaactgtgcacactaaaatgaaaataagcaataaaagcaaatagtactcaaaatttaaatgacattggttaacaatggagtacgaaaaggttattgaatgtgctaagtctaatgctttaacactcttcaatcattcaccttttaatgcagacctttaattatattcataatcttatcttggtgaactctacacccacacctatgaattctgtcaatttcttagttaaacaaaactctcctagaaacctaggaccagggtcagagatagaattaaaatcacccactctcaggagaaatggaggaagcatttacactgaaagtctgctgaatcccagattctgtaatataaaccacttaataatctatactgacatttcaaagcttaggaaagggaatgttgtacaaccctggacttcattgtgtttattccctatgaggcacagagcaagataataaacaagcccctcaagctaaaagaggaacacagaaacatatatgtgtgtatatatatatatactatacacacacatatgtatgtgtgtgtatatatatacatatatatgtatatatgtatatcacagaaacatatatatttcccaaatttttcttaaaaagcaccccagttcaggtatcttgaataaagaaaattagtcatagacgaaaaaaaagaaaaccttccagttgtctaccaagaaaaaactaatatggatattacatgcatttctattttgaagaccaacagtttattaatttattaatagaacctgtatttttctgtcaattattgtgctttcaattattgtgctttgaattatatatatatatatatgtgtgtgtgtgtatatatatatatatatataattttaacttttgagaatggataattttaacttttgagataaacattcagcctgcataaaacataaatctctatgaagtaaacatcttatacagtttctctctttaaaaatagctttgacatgcttctgatgtccttaaatatttgtgctgcagatgccatagttgtattttttcaaagactggctcagaggcttctgaaatattagatatccctttgctggcaaaacatcagagtgggtattcgatcattacaaggtttttcttaaaccagtgtttctcggattttactgtgcatcagaattccctgacgggcttgttaaaacacagaatactgggcctcacccccagagcttctgatccagttggtctagagaaagcctgagaatctgcatttttagcaagttcccaggtgatgctttgatgctgatagtccagggaccacactttgagaaccactgctttaaaccgttagtttataagttctttaaagagcaatgtaagcttagaatccagaacctacatggtacttactaaactctcttcagagctgtgttccaggggcattccttgagaaaatcatttttttttttaaactttcttcttttagcaacagtaatgcccaggcagctagagagtccttaatattcattgcttagcattttggttttgctgggcctggactgggagtattccctatttctcatcagaagggctgcaatctactgtgtatctccaagatgttctggatctaaactctcccaggataggatctatgcctctgggggaccaaagccacagctacatgtctttacccagtaagtctatctcatccaggaggaagtccatgtcctcccggctcacttgagggctgatcaccacctggcggaagaagttgacctttccccggtgcggctggtagcccagcatcaagcttcccttcttcatcatcctctccttaatggctggggccacctgtgtggggagaaaaggggagaggggtgaaagaccagaacatcaaggcatttcaatagcattttcaccagccattggacatttactgggcatccactggtttggatcccattctcattcacacaaggttgacactaataataataataatttatggaggactcatgagtactgattcaagtgctttagacatattaattaatcttcacaataacagtgaggaagatgctactaatgtgcccatttatggtcgagaaaacaggtacatggcgagtaaatcagtatctcaaggtcccaggcattttctccctaagcccatactcttaagtgtaaatcattattcaatgctgcctcattaaaaacaaatcaggtgtccacagggattacagtctcattctcaaatttgtcttaactaaaaaacaccccagttcaggtatcttgaataaagaaaattagtcatagatggaaaagaaggaaacccttccagttgtctaccaagaaaaaacaaatatggatattatgtacagttctattttgaagcctaagtttattaatttattaatagaacatgtatttttcatcctagaaaaaaagaaagttagatattattctcatatatgaaatataaacaccctgtctcttattaagagatgtaaatgtggtaataaaattaggaagcacatattttaaagatctatagctgacatgagaagtacaggccctgataatccagatacacagatttttctaaaagtttaatgtttgaagaaactagtctaatttaagaaccacatgggaaaatcagtccattttctaatcagtagtatggccaccaaagagctaggttgtaaacttttaaaatagtgaagttcatttttgatacactgagttaaaatattaagaatgcatttttactgtcttggaaatacaagcaaagtttttccacttgaattttattttaactctgaaaactttttgagtgtgtcctatgtgaatatgtggaaagggaatataatgagtttctatccttgccttctcaggaagatgagacttactcctccagaagggaggagtacatatagaaagaacaccaggcagagtgtgcttttaaactccttaggtgaggggcatgaatctgggttcccacgagtctccctctctcgtaatgtgataatcccacaccagcccagtttttgaacatacccacattttgtcagcaagtcaaatgacttcatctgacactcaacacaatcttgatctgttccaaagctgatgaaaaaattgggtgttttagacctctgaagatattatgtgttgaacttaaccacagagccttctcaaaggatgttcaaggttaattttaactcaacacttttttttccacatgtactaattttagaatataagtcttgcaaaacatggactacacagtgcttgcaataacaaaacaaacacctattcaggaaaatcacattgccattctagcaaaaaactggaagtttcttacattatcacaagatatgaaaagaaaatatatgagtgtaaaagaaaaaatgtagaaaaggtgatgttagaggtcaagttagtgaaaaaagcatgggccatcaggttctacaaacttctaaatatatgtgacacattttattctgagctttctagagattagaaaaatgtaactaaacaacagcctgcattcacttgaaaagagtggcaaatgtccagttgatgctggaagccagaagctaggaagtaactctctactatgcttatacatatctgcttcaaacccatgaatttgtatgcattggttgagttttcttccaaatccatgtatgcaagtagtaattctaaaatctagtaaaaaaatatgtaaaacaaagatagatgagtgccaaaaaaagtgatttttgtaaaaactaagttgagtcctttggaaagaagagataaagggggatggctaaacatcattgtgatcacactaggcaagagaactgtaaaagcttttgagaatccagactgattctgcacggagatcgctacacaggtgtctgagtacttacttcacctgaagaaacccgagctgcataagacagatgattcctgaagaatgtagtttatgcaagaacagtggagggccctctcatcatcagacctctacttaagaaaagtttcacttgtttataaaaagcatttggaaatcttcactaggtggaaaaaacctttccatcaaaagatggtaacataaatgtacactgatatacaaatataacattaaaaatttaaatataaagatacaaatattaaatgggaaaatgctcacattatgtatgtatcacattattttctagaattatttgctttacctgactaatcctcctcaccttaggtaggagggcttctcgtgcatatgtggatataaatgggtctgcgtgcataagcatgtgtgtgtgtgtgtgcctgtgcatatatgcacatgttaatatacacactcacatataatttaaacctctgacccaccatattgtactgcttttaaaatctctctggccacagggcaatggagaaccacgctttgacttaggttcatcataaaagtacacttgtttttaattcaaagaacaagtggctttctgaatgcaaactgtgagaaaaagacaacagtagtgccagtgctgaatcaagattgggaagacctggtttacatggaccaaatgtctagctagaagggccacagactatcagttttagagcttacagcttgcggttctgtggttcttgtttttgaaatcaaaattctcttcatgttcctctccttcgtcctccaggtacccagggtataactggctctggcttgtagccaattttaaatgtaaaacaggcatgctcttggctcaggcctaatttgcatagtgtattcctgtttacttttcaatacttccattttttctcccaaaatggtattttatgccttatctttggagagcattagaattttgattccagtacataatatatctgaggctcacatgaggcaattatcaaaatgaatctgtcacgtttgtatttcttgtgaggaagccagaaatactttctaacgtgaacaagaaaggtaaaggaagagggcacctcagatgttttaatataaagatactttggatgtttaaattcttgctcttgtgtaaagcgcatgactgtacttccatgggcaaaacgcagggaataaaaaccaaacttctaggacaaattttgttactgactttctgagattataaagacataactaaatatatgactcagagaactagctaagcaagggtttaacagtacaacacatttttatttatgagtctatgaactataagattaattcctacaggcagttactactaggtaaaaaaggaaggtctcccttgtctatgaatacttcgcgggaaagaaagtaataacatcaaagctgatattcatcaaatctttatcacaaactattctgctggtagtagtagttgttgttttta

SEQ ID NO: 34 - DNA, 5254 bp, Homo sapiens
tgaatgtgctaagtctaatgctttaacactcttcaatcattcaccttttaatgcagacctttaattatattcataatcttatcttggtgaactctacacccacacctatgaattctgtcaatttcttagttaaacaaaactctcctagaaacctaggaccagggtcagagatagaattaaaatcacccactctcaggagaaatggaggaagcatttacactgaaagtctgctgaatcccagattctgtaatataaaccacttaataatctatactgacatttcaaagcttaggaaagggaatgttgtacaaccctggacttcattgtgtttattccctatgaggcacagagcaagataataaacaagcccctcaagctaaaagaggaacacagaaacatatatgtgtgtatatatatatatactatacacacacatatgtatgtgtgtgtatatatatacatatatatgtatatatgtatatcacagaaacatatatatttcccaaatttttcttaaaaagcaccccagttcaggtatcttgaataaagaaaattagtcatagacgaaaaaaaagaaaaccttccagttgtctaccaagaaaaaactaatatggatattacatgcatttctattttgaagaccaacagtttattaatttattaatagaacctgtatttttctgtcaattattgtgctttcaattattgtgctttgaattatatatatatatatatgtgtgtgtgtgtatatatatatatatatataattttaacttttgagaatggataattttaacttttgagataaacattcagcctgcataaaacataaatctctatgaagtaaacatcttatacagtttctctctttaaaaatagctttgacatgcttctgatgtccttaaatatttgtgctgcagatgccatagttgtattttttcaaagactggctcagaggcttctgaaatattagatatccctttgctggcaaaacatcagagtgggtattcgatcattacaaggtttttcttaaaccagtgtttctcggattttactgtgcatcagaattccctgacgggcttgttaaaacacagaatactgggcctcacccccagagcttctgatccagttggtctagagaaagcctgagaatctgcatttttagcaagttcccaggtgatgctttgatgctgatagtccagggaccacactttgagaaccactgctttaaaccgttagtttataagttctttaaagagcaatgtaagcttagaatccagaacctacatggtacttactaaactctcttcagagctgtgttccaggggcattccttgagaaaatcatttttttttttaaactttcttcttttagcaacagtaatgcccaggcagctagagagtccttaatattcattgcttagcattttggttttgctgggcctggactgggagtattccctatttctcatcagaagggctgcaatctactgtgtatctccaagatgttctggatctaaactctcccaggataggatctatgcctctgggggaccaaagccacagctacatgtctttacccagtaagtctatctcatccaggaggaagtccatgtcctcccggctcacttgagggctgatcaccacctggcggaagaagttgacctttccccggtgcggctggtagcccagcatcaagcttcccttcttcatcatcctctccttaatggctggggccacctgtgtggggagaaaaggggagaggggtgaaagaccagaacatcaaggcatttcaatagcattttcaccagccattggacatttactgggcatccactggtttggatcccattctcattcacacaaggttgacactaataataataataatttatggaggactcatgagtactgattcaagtgctttagacatattaattaatcttcacaataacagtgaggaagatgctactaatgtgcccatttatggtcgagaaaacaggtacatggcgagtaaatcagtatctcaaggtcccaggcattttctccctaagcccatactcttaagtgtaaatcattattcaatgctgcctcattaaaaacaaatcaggtgtccacagggattacagtctcattctcaaatttgtcttaactaaaaaacaccccagttcaggtatcttgaataaagaaaattagtcatagatggaaaagaaggaaacccttccagttgtctaccaagaaaaaacaaatatggatattatgtacagttctattttgaagcctaagtttattaatttattaatagaacatgtatttttcatcctagaaaaaaagaaagttagatattattctcatatatgaaatataaacaccctgtctcttattaagagatgtaaatgtggtaataaaattaggaagcacatattttaaagatctatagctgacatgagaagtacaggccctgataatccagatacacagatttttctaaaagtttaatgtttgaagaaactagtctaatttaagaaccacatgggaaaatcagtccattttctaatcagtagtatggccaccaaagagctaggttgtaaacttttaaaatagtgaagttcatttttgatacactgagttaaaatattaagaatgcatttttactgtcttggaaatacaagcaaagtttttccacttgaattttattttaactctgaaaactttttgagtgtgtcctatgtgaatatgtggaaagggaatataatgagtttctatccttgccttctcaggaagatgagacttactcctccagaagggaggagtacatatagaaagaacaccaggcagagtgtgcttttaaactccttaggtgaggggcatgaatctgggttcccacgagtctccctctctcgtaatgtgataatcccacaccagcccagtttttgaacatacccacattttgtcagcaagtcaaatgacttcatctgacactcaacacaatcttgatctgttccaaagctgatgaaaaaattgggtgttttagacctctgaagatattatgtgttgaacttaaccacagagccttctcaaaggatgttcaaggttaattttaactcaacacttttttttccacatgtactaattttagaatataagtcttgcaaaacatggactacacagtgcttgcaataacaaaacaaacacctattcaggaaaatcacattgccattctagcaaaaaactggaagtttcttacattatcacaagatatgaaaagaaaatatatgagtgtaaaagaaaaaatgtagaaaaggtgatgttagaggtcaagttagtgaaaaaagcatgggccatcaggttctacaaacttctaaatatatgtgacacattttattctgagctttctagagattagaaaaatgtaactaaacaacagcctgcattcacttgaaaagagtggcaaatgtccagttgatgctggaagccagaagctaggaagtaactctctactatgcttatacatatctgcttcaaacccatgaatttgtatgcattggttgagttttcttccaaatccatgtatgcaagtagtaattctaaaatctagtaaaaaaatatgtaaaacaaagatagatgagtgccaaaaaaagtgatttttgtaaaaactaagttgagtcctttggaaagaagagataaagggggatggctaaacatcattgtgatcacactaggcaagagaactgtaaaagcttttgagaatccagactgattctgcacggagatcgctacacaggtgtctgagtacttacttcacctgaagaaacccgagctgcataagacagatgattcctgaagaatgtagtttatgcaagaacagtggagggccctctcatcatcagacctctacttaagaaaagtttcacttgtttataaaaagcatttggaaatcttcactaggtggaaaaaacctttccatcaaaagatggtaacataaatgtacactgatatacaaatataacattaaaaatttaaatataaagatacaaatattaaatgggaaaatgctcacattatgtatgtatcacattattttctagaattatttgctttacctgactaatcctcctcaccttaggtaggagggcttctcgtgcatatgtggatataaatgggtctgcgtgcataagcatgtgtgtgtgtgtgtgcctgtgcatatatgcacatgttaatatacacactcacatataatttaaacctctgacccaccatattgtactgcttttaaaatctctctggccacagggcaatggagaaccacgctttgacttaggttcatcataaaagtacacttgtttttaattcaaagaacaagtggctttctgaatgcaaactgtgagaaaaagacaacagtagtgccagtgctgaatcaagattgggaagacctggtttacatggaccaaatgtctagctagaagggccacagactatcagttttagagcttacagcttgcggttctgtggttcttgtttttgaaatcaaaattctcttcatgttcctctccttcgtcctccaggtacccagggtataactggctctggcttgtagccaattttaaatgtaaaacaggcatgctcttggctcaggcctaatttgcatagtgtattcctgtttacttttcaatacttccattttttctcccaaaatggtattttatgccttatctttggagagcattagaattttgattccagtacataatatatctgaggctcacatgaggcaattatcaaaatgaatctgtcacgtttgtatttcttgtgaggaagccagaaatactttctaacgtgaacaagaaaggtaaaggaagagggcacctcagatgttttaatataaagatactttggatgtttaaattcttgctcttgtgtaaagcgcatgactgtacttccatgggcaaaacgcagggaataaaaaccaaacttctaggacaaattttgttactgactttctgagattataaagacataactaaatatatgactcagagaactagctaagcaagggtttaacagtacaacacatttttatttatgagtctatgaactataagattaattcctacaggcagttactactaggtaaaaaaggaaggtctcccttgtctatgaatacttcgcgggaaagaaagtaataacatcaaagctgatattcatcaaatctttatcacaaactattctgctggtagtagtagttgttgttttta

SEQ ID NO: 35 - DNA, 2140 bp, Homo sapiens
aagacttactgatggctgtctaaataagataggacgattctgaaattaaacccagtaggcagaatgcttctaaaggctacccaggcccatgtgctgaaacctatttcgttaaagtactgctgtggtttctcattccacacacacagtggtacctgactgagtacttcactgagaagcttgagcagaagatgcggctctgatgtagtgctgttaagttctctcaggtaactttagggttttcgacagcttttccttttaaacttaagggaggctagatccacaaaccgagcactagcacaggctggcacgaaacacagcttaactttcatttcaggcgttgtaggggcctatctctcttgctgacagttacgggtgcagtttaagcacaatctatttaagtggtgcaccttgcatggagatagacatgtatggtgaaagaggatgggagtaacaatggagtctgtgccgcagccagtctctgcttttagataatgctctgtatctagttactataaatttgggatagccctggcgatgaggatgctgtgggacactgtttgcttctttaaatcaccataaccactcataaacccagtctcgaggagttatgcgagtgtttttctctgtcctttctcttaacctgttccccttaaatatcgttacaagaaaacgtccactggagcatacttcatagcactgtgacagtagcagaagggagaaagtgactgttctagaggaacttcccccagctcttagttcctttgagtatttagaaagtggagtccaaagatttgttagcatttgagatgttaatggcaggttaaaacaatctaggctgctggaagacaagagttttctatttaagttaacaagataattaagttctcaaataactaaaagtggctagaagtcaaatcagtataagatgatggcaagctggtagggcttctgaattcagttgagaacacaatcctcgttttttaacttggttttgaacacttcattgtcagcagtatttaaatattaaattttaaaaatagattcctaaaggagagtcataacgggcatcttcttaaaccagctactctttaaaatcaaaatgctgtcactgccaataaataagtgcagtgtctttttcttatgggtgagtcagttatttagtctgatttcaatcttctaagtaaccttgcgaaatattaaccacgctacacaggccccacccctgactgcaggcaagcagaaattcccttcagattgtgtgaatggagatagttccaatctacgttacatgatctatacacaatagtatgttttctgacatttattcctttgattcagaaattcttcctcaaaaccatgtattttgaattctagtttcaaatatgtctttgaaaatatccatggcaggtttgtgcataatttgcattttgcttatttaccttggttgaggtttttccttagtttattttttaatttttaggaaaaaattctcaggttttttcaatcctaaaaaaccaaatttaaggaaggatagtttctttgtagaaaggtgattaatgaaaaatccctgttcttgctattctgtcattgagctctttcaaacaagcgtcggaagaccaacagacttaaagataacttgttttcttacagtacttaagatcactcttgtttacttgcgggatgtggcttagagaatcccagttcatatttagataatatgaggaaaccaacgtgaatccagtgggcacaagtacaataaatgaaaacttaatttgctttttaactaaacttacaaatacatgtgttcctatgcaagatttatctaattcataaattgcaagaaaacaggctagcttccttgtacacttaaatctctgaggctcctcactcaacttttgttttagtggaccctgcaaatgaggtaactagaccattgatgaatccagaagagggaagcaattgcctaaaatgacatcactactgttagcacgctaaaagccatggccacctacggattttcccaaggaggactgaggtggtgagggctacttgcattaccaattgtattctatattttccaccttcaaatagtaaactaaattagtcacacaggctttcctgaaaaagcgtctgattgcta

SEQ ID NO: 36 - DNA, 50632 bp, Homo sapiens
aacacaggaaattaaaaatgcaaaaactaccagtcaatcaggaaatcagcattgtggatgtcagggctttgtaggtacaaattggggaattagttttttccatgaacagcagtatatttactaagtaatttcttttaaactagagttatccttttacatcaacagaagaaccaattagaatcactattcatcaattattgtcctaacacaagccttgtgttaggacctaggcaatagagcttatcaactaatcaactataattttaatcattgtatcttggagttttcaaaaggaataatttggggtaagggaaaaattcaaattcttagttactgctgacatgaaggcagatacttctgaggatgattaatgtatttaatcaaccattcagtttttaaatagatattagtgggttttttttcccctttttagtgaatacttgctaggcactgacaacacagtggtgaatataatgacattctttctcctcatgtagcttccattctagtgggagagaatattacatgaaaaatcataattacaaatagtaattatacacactattatgcaaatagtaactatataagcactttaaaggagaggaacagagtctgagaaacaacactggggaggtgccagtttatcttggtaagtctggggactcttcaaagaagagggtgacaataagctgtggcatgaaggatgaaaatcattcacatgcctcacattttgtatggctcagaacacagttatccaaaatatggcaccttggaggtcactctctgatctcctctcacctttcttccctgaaacatggtcataaataattatttgacctacctcccctaaaaggaggctgttaagaacctcattctggaggggtcctaccctatgcctggaagtcgagaagactggacaaacaggccctgcaaagtccccccctgccagcttatgaccatacttctgcatgattgtccagaaaaatatagttttccctgggcctttggatcttcatctctgaaggttcttgtttcacaaaaaattttggttaaataagtttgttatgcttttcttttgtcaatgtctttcgttatggggaagtcagccatgaaccttgcaaattggggtaaggaaaagagatgactttttctttcttacatgttcttccctgtctggttagcatcactctttctggtcttcccaccatctccctggccattctgactcagccttcatggggaatccttcctcctctatctaatctctcaatgctaaagtttttcagggctaagttctaggccttattttcttctaattccaaagatcctcccaaggcatctataacccattcctatgacctcagatatcatctatgtgttaacaattctgtaatagactttaccagtccagacttcttttcttagatttgggtccatatgccaacttcctatgtgacttcctcacttgaatatacctcttaagaacctcaaatttactatgagcagcactaaaaggtgtttcactctcaactctttcctccagtgatcttcatcttcctaaatggaatcattcgttcagttgctgtatcagtaatcaggatgattacatgacacctgcttctctctcatctcccataattgataattgataataattgataattgagccctgtctaattgatagctaaaatgtatagtgaatttcacattttcccatctctcttgccatcaactctggcatagatactgcaagcctttttcttagtcttccatctattcttgttcccctccaattcattgtcctaaatgaaaattttttccaataactcttttagttcttctgttgttctaaagatcaagtctaaaatcatcacaatggtctctaagacccttcatgatctacccactgcttaatcctttagtctcatattatgtcaatcttcacattattctctatgcctcagccaaaatacgcttttttcagtttctaaaataattttttttaaaaagggcgttcctttcttaaagaattttcacatgatgttccttccacctgagacatcacctgctgtgtattactgaagtactatactcttctctgtattagacaagggtgcatttggctgcaactaacagattacccaatggagatggtttcagtagtaagaacatttaattttaaccacttgatatcgcaaagtctgaaaggagtcacgttttgggggtgcaacatttcaaaattaccccaaaccaagactttccctttgtttctgtcattctgtgcatattaattttttaaatttagggtaattgccttatggtaacaacccgtatatcatgtctgatgcaactgcattcaaggtagaaaaatgcgagaagaatgctctcgtataaaattattctcaaggtcctcaccacatttccctacatcacattagacataactatgtcatagaaactgcaggggaggctagttaggtgaatattgggagataggcaagaagagaaggaggctggaatgcctgttgatttttacaatcaacagagtctgacatttgttagtgcacttatcaaaacagcagttaaaaaattaaatatctgcattttgttcattgtcttccctgtgagattataaactctttgactctggggaatatgtctgtctgattcaatgctataagagcctagactcgcacagtgtcaagcctacacagatcatttatgctgattgatggaatgaattaatgatatggaagagagtaacagaggcagaaaccaggtacaaaagagatagaaaactgccaacacaaaacttaaactgattgccacatctcatatctcatggtttagctttcctattccatttaaattgaaaacggtcttttcattaaaaaaaaaattggcaactttttgaaagtgctcagttctttgcacagtgaatagaattcccctaacctcttaattcatgccatgaaaatagacatgggttttattgtcactaagattcaggaatgaattctttaaaaaaaaaaaaaaccctgttaaggagttatatgatccagaaaaatttaaattgcctcaagtacagaaatgtaattcagttgttgtctaaattactcaaatatcagttaataagaaaagtatatgaaagctagaaagttacttaagagtagtcataaaatttttagtctaagttctccactccttagcatatcacaccaacagataagtttgtcagattggccgatttaggtagaaagcaaatgtaaaatacctcactcataaaggatgcttgatacatttttgttcttatacctagaccaaaagaaaacttgggtttattcctatctctgtcccatcctaaatgtgtacctatgggcaagttgattacgttctttggttcacaatcaatatggtaatcttaaactaccttttagttacaaatagtcataccacaattttgaaacttaaatttaaaaattaaatggtattgaatacattcaactctatccaacctaataaaacattaaggaactgattcatatttctggtagtgtctatttctatagaagcaaaacctgttcctagtttctgatggacagtctgatcatgtcaaaacgcacagggcactaacataaatatcacaatttctttaaaaagttgtaaatagctacacatgcaagactaggtttcaagttttaaaaatagttttcatttcaaataaaattccttaaaaacagaaaatgactttaacattggcaaagggagtcccctaagaaaaaaatgtaaacagatggctgagaaagatcacccacatgctgaacacagatcttgaggaggcatttctaagaatgaagtagcacttcccagcctgggccacttcccacaaggatccttatttaacccatggaaaacacagagtttatacctccggccaagaggagcctcaactttttttccacttgcctcacagtgatccagacagtttccaactctccctagcattccaaaagaagctaagtaccaaccacttgggatgagcaatcccctaataaattagtgttcgaagatcagccctgaacaaatgtcttcccatataaacgggctgttaagccctagctaagcgtattaagtattcaatttaatgtatgacacacatctgttccactttctcagtgagcagaagtttcaagataacttaaatcccagacttaatcaaggagaaaaaaatcttggcaatgtttaaaactgagttttaaaatataatccaaatgatggtgagagagagaccattttgctgtaactaatgagattatataatacctaaatcaaatccacaaaattacctgagcagaatcactaaatattttatctaggcttatttgtctttcatgtagagaccatcaacacatttcccaaacaccttcaatttacgcctcgcccaagtcaccaagagatgagcaaaaatgaagcccttggcaagcacagtggcttaacccccttgaagcccaaaggaccacaagaggaaaacttacagatttgtctttcacaaggagagcacagcactggatcccagccatcagcatcttgtgtgggttccaggccacagagtcagccctattgtttaaacaaagggacagagtagggagaggactcaattagtttctacaggcaatggaatactatcattatcaatatctgcattcagtactcatacatagtttactgttctatagaactccttatctgagtggtttaaggaatttggagggattttttgttgttgtttatttaaggaaaacaattactttgttttttcctattttcaaaatatcacttagtccaaagagatccctttgcctgacaaaagttggctgtacaccaggaaactacatttacctgtggatgccatgcagaagcttgcggtgcttcctcgacatcaaagctgagccaccccaagaagcctgttgagatatttacagtaccagaacaatgttatttcaatgttatttgtttaccagtgggttgtcatagaaaaccctcagtgaggacctcaatctgcattatttgatattttatgtcatgttaactaatttgtaccccaggaaattctgatcactggctctactcaggcaaccagaacctcatcacaatagatgggccctcactgacccttagaattataaattcatgcatcataaattggtatattaaccaactgagctatgtgtggatggaagaggttcaaagtccatgccctcttgaagcttagactctaacatagacaacatcttcacaatgctaacattttgctattcagtgtatgatgagacatgggctaaggactagtattttatataatgaatgaggcatattattgacaaggtagatagaaggccaactaggatgagctaggcggaaatatctgttaatgaaaaattagatcattttagctaaatggctttcagaaatatctacaaatgagagagagggcaagcttgggacaaaaggaagttatccactggagaagtaaattttgtgagcaaaggagaggggagctcagataaaatcccatagtcaacaggtctggagcaaagggagaaaaattgatgtaagaaatacaaaagtcagtatgcttcttgaaaatggtgcagacataaattttaatttgtaggacattaaaggataactgtattgagagaatttgaagggactagcttgggctgtattgaatgctttccaagttgatttaaaccttacagcattccattaggaatggagttatgatcacttccactttttataaagttcagaggtgttcaggtaaattgtccaaggtctcgccaatgacaaaaatcagatctgagattcaaagcccattctcctgtcatgttaacatcattacttaaggaaggtgacaatttggccaaactggggagtatagcatgtagaatgagggtgacagagatgctttaggcaataggtaagttcaggggttgcttaggatgtagcaacttctatttttggctatggaatttaaaggcataggtagaccttaatatcatgtaaaaagaagtggcatggttggctgcaccacagatatggaagataaagaaaatgaagtatctccacgatcctcagagtattacaaaatttgggcccattggtagccaataacaagaaagtacagcacaagcaactttgtggccttaaatcccacttaaaaacaactttcattgacagctgagactagggtgaagtgaatgagtcagggtgcataattcaaggaagaactcatctcagagctggactcttgcaaggccctaagagtgaatgcttcttaaaatttgagccctgccaaccccactggcctcatattagcaccagccttgtcccatggactaaaggctccatcaactccatggggtccccagaggcctgcgagctctgatgtgtttcaagggtgttgggtgttcaaatcccaaggattcccaggtaaagagttagtaacttggcattatcagtcaaattcccttcctgctgcatttcctcccttacttggattcacaatggaccacgtgtgactcaggctgagccacaaaggcaaatgccctcagcatctaggaaaattttatccccagcctacaactgaggatctccagatctggattttgagaacttggtccttgcaaatattaagatgtgttacatatcacatttttcttgactttcattacatattctaaatcctaaattacctacttttctcacttctcttatcccccaacctctctgagaacctatcagtgacaactacaggaaggattaattagtccagtcagccacacctgtttgctcgctcacactttccacctgcctcataccctacacttctactccttcatgctccctgagctagcctctgcctccactgcttctccaaaaaggtaaataatctcccaattctagtgaactggatttaagttttgaaatcacaggaacccttccaaggcattagttcaccacttcacaaagtactttggcagggttaggaacagctcatccataaatttattccttaaaaaaaaaaaaacacccctgatgtaaatgccctactttaatttgctgcactctaattcctaactccagaaactgtgaaattatcaaacctatcacctaaatgatggagtttggctttccatctcaataaagactgtcatttattaagctattactatatgtgaggcaccacagtatatcattttatatatatttgtctttaattagttaataaattaatagtagaaccaatcttgaaagggaagtgaaggtaagaatggaattgagatttggcagcctctaaaggccatgattttaaatacgtttgtgccttctatggcacttggaatgaggaatgggtgagagaataggaagctttgttgggaatgagaggctttccagcagctacaacctctgattttgaagaagagctagaccagcccgacgttttgttctcagacagaaactagcataacaattgccctcatgaaggaagagaacagtactggagtgaaagagtctaataaaactagtttttcttattcggttgtttaaaaaacgcattatattaccaaattgaagacagtatcaaatgtaagcacccccattttttgtgtactactaataaaaattgacatcaaaatatcaatttcagagttaaaatttttttaagtaagtgcatcttagaattaataaaacatggtatgtatgcagagcagcatggttttactgaaaacccagaagaacaagtaaatgtctttttatttttaaaaagagataaacatcagtttaatatttgaaagaagctttaaaatactctagaagatttcaaacaggtcaaagcaattattgcaatttgttaatattttctttaataaagtacctatggcatatgaagtttcttcaagataagctacatgttcctgtagtaatattttattgatttgacacccacaatactaaaggatgggtaaacatgtctttaataagccagataggcttgtgtcaaatttaatctaatactataggcatttgccagatgtatactatgcacaaataggataatttggtgtggtttacattcccttataaagatgttttcttcaaagactcaacctttaatttttagaaaacctgaagagcttttcattcataaatcacaattttctctaagccccataaatctcttaatgtcattcccaatttaaaagctgctgtggtgactgttttacataaactatttacttttctccattttatacaaactacataaactatataatccatatgtgatgtttcttttatgagagtacaatatttaggtagaactgctgatgtatttgattttcccccttatttccacagttacaaaaatgctcacttcatattatcttttaggatataatgtattgttatgcttctaagtctataaaaatcaataagatataagttgaaatatgaacagatacaaatgctaaaatcccgttaacgagtcacggataatctacctcaagtattgccattggcatactaatagaagcaataactctagtaaactttatactactgttgcttttacaaatgttagtattcagttaatgtaaactttgaatcatatcacagacactctactaggtgatatgatttgattgaaataaacactttgaaagcataaaatcatctaaactacaaaattatgtgggtatatccccccaaatgctgtttccttttgttcagcaagtcaaaaaatatttcttctgccaaggaggatctgaaactatcacttaccagaggaaagctcccaaaacaccatgtgcaattgtctctttggttagaatcaaactaattaactgctggtttcacacaaaaaaaattaattttaaaaaagaaaattaaaaagctccacaagtgttcatagttggctgaattcagcattctaacccgggataagtagaatttttaaagttaccttcgatttaaggaaatatgtattttgaataaccgcaggacttacaaaaattcttttaaaaagccaatcctttgctagaaaataatggagtatattatcccaacccccctcaaataactatctgatagatccagagaaaatttgctttagttatagcatgcaattatgcattgtagcttttttgcattttccagctgtttggaatcataattttagagctagaaagataccttacagcccacatctaccatcccccctctttacaaatgaagaaattgaaatccaaaaggctaagatcgcaatgaagaagaggcagatcagaatttcaaaccaaagtctctcggctccctaacctaaaatgggtgccttacaccaggctgcttcaatgacagtagatttgaggaccaaagatggctcatgggagtaaaagaagcaaaatggaatccagaaagctaaaacaaaatatacacaaagtcgtggaatcttctcatttatactttacaagaaagtggcatacttatttcccccaatttgagacacaaacaaaagcgttggggactccacatctagtttctgagaataagaaaaatttctaccaaggctacaaaaagaccaaaggttaaacaggtatgtacacataaatgaacttacatctacatgaagccagaggctgtgcctctcgcagatgtctgctatttcatccagagggtcaaaagctcccaacacagttgtaccagaagtggcacagacaagaaacggtgctgccccctgtaagaaggatccacacacacaaaattatcactgtcatcactaaatttgtcctgtaatagctggaaaatataaagggttatgcatccagagagttatttgggttttttggaggtagtcattaattcaatgggtgtttttaaattttgtgaatatgtggcctcttggcattataaacagattaaggaaacagaaaatgctatggcaatagcattttctgtcccaactcagtacatcttcagtattattctcatgttttttgtaatgttttgttctatcaattgtccagatagaaatttaataacttcagctgcaacagcaaactgacattttgtatgactcctaatttcttcctgaaaaaatacatttagcctccattgtgccatcattgtcatcttctcaaaaaaaaaaaaaggttggaagacagagctcccggagtaaaccatgcaggcctgtttgctcatctccttgtaaagtaagtgcagttataaaacaaagaatgtagaatattctcaggtacaaattcagcatcagaggagataaggcaacctcactgggatacattctccaaaataggtgctgcaacagagaaatccattggcatgtgctggaaaagaaaatctgtgtcacttctatcatggttattcctcctcatatagctgatgactgcatcttgtggcatgaacgggtactggtgggaaatagagaagaaaagggagaatgtgggtgcacacaaacagatgaatggttatctcggtcaagctagtcacatgctttgtccccattaaaggactctatgccaatcagatagatgaagagtacatgagattgtttccaaatggattgctccaggatggtggtagagatgtgttgctcgctgtgtaggtgaagtttgcagacaaatgtgggggtgaggggagcaagtagaatattaagattctagagcacctgagaaatagacaagaatatttactgcctctgaaagtttagtgcctctaaaagttatttttttctccatttagcatggagccattttttcccctcagttttataaagtgcatgctcattgcaatacatttttatgtcctttaatgccagggattattgtgtttgaaccaactctttccaatttaaccgacttttgacagaaagatgttatttctcaatggaaagtggggcagagcaagaatatgtggttcgcctctctaaactgagatgcatacggatcaaagtggtggtatataacaaatccatttgccatcttgggagacagctgtggcaaatagaatcaatcccatctacccaaaacttttagagccaagtcagtaggtgacagagccctggagaaaccagaggctttgaaacttcttccctgtattcaaactactgacaactatggctttatcataccagtgacctaaaggacataagaccagctttacaccaatcattaaaatcattaaaagcaatagaaaaataatttactaaaaccatttaagttgtctttaatggttgcgcttttcctcataaactatatgacatcctgacagtcatgagaaaatacatttgcaagctattatagcctattaatgagttttcctcacctttaaaaaaagatctcattaaaaatacaggaccagaaattaaacttttgcgatctggatttaacctagactttcttccccatatctcctgctgttaatgagaattcagtagaaacagtattgatggcatgctgccagtgagctgtattgtctaagaaaatttgtcatttctaacacaactctaacaaaatgtctctaaatattcaatgttcatcctagtttgagcttgtcagtaagccctttaggacctctgatgctttgtgtttttcaccatctatgtaatgacatcaagacaaggtcactgcaacagtttttcaatggattgtcataggccagggagttgaatcccagcagaaaaaatagttgatggtactattcctcatatctgaaacaacataagttaaaagcttgaaacaaaacaactaggcctgaagctactgagaaaaaatgaaccagtcatcatgtattattatctcagaatggatgcaaggtttgtccttggtgaatccaggctcaagtattagctgacttgaaagaaaactgaggagacgtactaactctaaccccattgccctacttttaaatgtgcctaaagcaatttttacttttcaaaaacttacttttttgagttctcaactttagtattatgtccgtttcatgtactttcactgtcaaaacaaaaatttgagcgacaaaaatgataatgactgtggtggaataaaaccctctatgctagaaacatgaattcctaatgacactaaaaaaaaatggggattatctttaggggatgctaggcaacaaactcactattttaaaaattgataaataaggggaaagaataagacgtttatcctgtcttgcctgtgcagtgtttccttagggaaacaaaatgaggaggaatatttttctttatagtagaatgcctgacaataaagaaggaaggagagaaggaattaggacatcacttaatgaaataatgggtctagacaatgatcatcaatggcagcaaaaaccactaagtgagaagctgatggagtggagggtattgtgatggatggactgacgataccagaccccaccaatcaatgttattacaaaagagacacaggatgtctcctgatggcaggagccaatgaagcctccctggttttaaaaaaagaaaaatacaacttaaatctcattgagtctcaagatctaactgccaaattacagaaaatataaagaacaaaccggatggtgcagaggaggtgagcacttagggtctcaaattcttgatgtaatccacaaaaatctataatgtggaaagctatatgggacaaaagacctgatcttttcaacaaatcaatggtagtggggggaaagaggaggaggaggaagctatagatcagaaaacatttacatttgacgtatcaaccaaatgcaatttgtgaactttatttgaatccttgattcagacaagtcaactattttttttaaaagggcaatggggaaattttaatatacactgaagatttgatattaaaaattatattttaaacaaaactatggtatgttgtttaagcaagtacgtatccttcataaatatactcaactatttatagatcaaatggtattatgtctggggtttgcttcaaacctatctagtggtggtatgagggtatgtggtacagatgaaataggagcatgagcctaatgactgctgattacagaatgggtatatgaagcctcatgatattagtctcttggtttttgtgtgttttggttttttaggaaacatttacaattttttgtaatgagaagtttaaaatttaagaagtggggaatagggaatggagaaagggaggaaggaaggagaaatgagggagggaagaaagacaatcatgacacaattaatattccccaccaacaagcattaacaacataatgcaaattatttttgataggaatttatgtaaaaagaaatgaaactaaaactagaaaacaatatctgtggttctcagcagaacgaacttacaagttgttactcagaattataccagagtcaaagaaatctgatcatgcaaaccaccagataacaataaagttcacttgtcattggaatgtttaaaaaaaaaaaaaaaaaaaaagtaggacacacacctgaagtcaatacatctgcaataatggcagaaattttaaatacagaagttcaagccaaatattgtgatctagcattctccaggactaggtagtttttatgaaaacttgaaaaaaaaaagtacaacaacagaactataatattcaaacttaaaaacattaaaaaacccatccttgttaaagtatgaactcctatgaggatagatacacttgtatcccagctcaggagccaggctttttatttttcagtagtcatgcctgcctttgttgctacctattggaaggttattggagaacggtctgaagctccatcagcaggcagcggtgggatgggagagaagcagcaaatctagcaggcttttggtccaaaaagcaaaatggctgagaccaaaataatgatacacctttttttttttttttgagatggagtcttactctgtctctcaggctggagtgcagtggtgcgatttcagctcactgcaacttctgcctcctggattcaagcgattctcctgcctcagtctcccgactagctgggattacaggcatgcaccaccacgcccggcgaatattttgatattgttggtagtgacggggtttcactgtattagccaggatgggctagatctcctgacctcataatctgcccgcctcagcctcccaaagtgctgggattacaggcgtgagccaccgcgcccggcctaatgacacccctttttaaaatgcaggtgttaaggccagccttggctggagcacagcaggtgcccagagccatgccttgccttctccaatatttcagttctaatatattctagcagctaaggaagaaaggatgttctgtcactgaactactagatacagacccaacaggggttgatagtaatagatgggtttgggattggaagcaacctgggagaataggttggtcaagaaatcaaaaatcaccctgaatacagcccagagaaaattggtttgtcctgcagatttctcagagggaggaattataaggagaggagaggctagggccctgctggagaggctggattgatccttagagctgcttctagccaagaatcctgaatacgggtgatttcagtgttttaatagtctccagccacctgggaacaagaatatccgggaaactccacagaacatggagagccaagcacttggaaatagaacatctgtaaatgagttttcctattttaattccaacattctctctcctctctcccacacatagaaatggttttggctgtttgcattctctccttgctattccctctctttcataagcgcgcgggcgtgcgcgcacacacacacgttctctctccctctcgctttctcccctctcacctcttttctggcttgccagacttgcttctccagttcctcaggtatcattttacctctaagggacaaagatttgagactttcagttatgtttagtaattaacagataatgatactgctttataaaccatataaacttttccctccacccaccaggcttccagatcctgttcccattaccttccatctgtttccacaaagcaaacattctcagtgccaatcccaagaaaagaggctgccttcttcatagagtaatgacactgaattcaaagggacagtggggaagggggagacatgaaaacatagcacaaaaaaagcattgcttattatcaaaggtagatgaaagtatggctgagcacaatctttgggacattattgcataaaaaagtaatttaattgagctccttagcatagtggttgagaacattcactttggggtcagagaaaccaggattgaacgtcaagtattccagttacagctatggaatcttgaacaaataatatacactctccaagcctcaatttcctactctttaaagggatcatgccaataatgcctactccatctgctcgtgctagacaaaaatgggttaataatatatgtagagggcttagcacagagcctggcacatggaacaaactaggacaccggaggctgttgttttccatcccattgagaaaagtaaagtttctcctgatgctcctcataagacttagtattaatggaaacttagaatctagtccactgctgacttgaaaccctctaaggagagggcaagactctatctcaaagattgcaatcacaggctagagaggaatctaattatttcctagagcaaacaatgagttataagtgctgatcagacacttgaccaatcttgtttaatactgaacacaagactgaaacacccaagaatgtggctaaaatcctaagaacaaaagtaataatagacaaactactttactcagctatggcatgagtgaggctaatagatgaatatggaattaagtctggtctatttcttattgataaatagtagtgtgtgctttacattattgggccttctctatactacatgaagcccataaaataattagcatgcaaacattggatatgtcgctcttcatacattagtgaggacaggtggtcaattaattctttttcttgccagaaaaatgaaggtgctaaaggacattattgtaccaaaaaaaaatcttagtaatttgtaggtatgaatacattaaaagagtagtcatgccttcacacttcacttgatatattccctcaaatgtggtaatttttttccttttgtcaggagagttttattgggagctctttttttaactctgtaaaaataaatgcagaagtaacatcaggaaaaatgaaaccgttctaaataattaatttccaaatatcaaataggacatgtccaaaatgcctgtaggatgcttttatttcaggttgttaaaagaccatatgcatattgaagagtaataatgtacaagaaagtgtaattaattctctacttgctccaccagcctatgctggctggcggtaacctgcctgccatagctaaggtgacatagctcgggtgaattatttctcaccagagagttgagctctggcaaccaaacagctattgatttcataatgataaatgctagcctaccccactgacatctaactataaggaaaagcacaatgctctccccctgagaaatagcaaaatatctccaaccaatgaatctgctgaataaaaatcttgtaatcagaattagaaaagtggagctatctttaagtacctgagggcaaaatacaacccaatgtcaatctgagatagatagatcaaaaaaaaaaaaaacaaaaaactgcaaaactgaagtttaaacatctgaaagcttcagagaaggaagagccctggaagggagaacaaaagaaggtgatgcttcagacatgctgagtagtttcaaggaaaggaaaaacctagaaggctggaattcagaagtaacaactgcatttagaaacaaacagtggcgtttctatcattggcaaaagataagtcagttgttctaagactcaacctccccacaggtttcataaatctacagaagacgaaaaaaactctcagcgggtgttcatttctataaagataaaatagcaagtgcctacatgaaagagagcattgagctggagttttactttctggctcccacaaggatttttttctatgaccttgagcttctcaatgaactgctgctttctcctcaatgtacactgtgccctggacacctggactccagtgctgactaatttgattctcaagttagctggtagagagaacggggtatataaatgtacactgtgccctggactccagtgctgactaatttgattctcaagttagctggtagaatggggtacataaatgttacattttagagaatgaacaaaaagagtgtccaagggatgtctctaacaacacacagctggtttaattccccaagaggccagaaccagaagccagatagactgaacccagcctcatgctctgcaggatgtcctacgaagcacctgcttgcccgtggagaagacctgcaatcacatcccatcgcaactcaacctcagccctcacccagcaatcaggaggaagagaaagaggcacctagagtgcaaaatttagaggcatgaccctgagacacaccctacataactcacttgcctctcctggcctaagccctgctagagaggagctagcccattgattactggcctgggaggtaagggtttctttttaccctactttttagtggcaaatcataattactgctttatgctaattccagaagtgatctgaaatatacaggaactttacaaacacgggatttctatacacccaagaaatttatatcaaagtgcaaaccaagacatagatttattacttttatttctccaaaagtccccttctcttagatgcctatttagcactagagaggcaaccttggatatattgacagtgcaaaggtctttgtcatgaccttgcaggtctttatcaatagtaaaattacaataaaagcctaacacatgcaaaaacaccttcagtggtgggtacgtatattctgcactggatggtgcaagatagaaatggagtaatttggggtagcacaaaaactggaaaagactacctaatataacagtactgggccatggaccaaacccttaaaagaaaataagggaggtatagcaaaaagactaacgcagagtttaagactgtttactaaacacaaccttctttaattctttaatgaaatagatggatttgttgtaataagtagtaaaggcagtcaataaaatatgaattaaaatagtgcaaatgctataacctgactctttgagtagggaaaggaatgagctgcaaagtagtgtcttgaccaatggagtcaaaatataaattcaaggctacagtgtgctcgaagtgatgtaatttttctgtggaattcacacctagttcttggtttttctggctccagcttctgctgacatgttagccaaggcatatattttgcctctctttggaaagtttttaaaaaccacttagttatggtttcacaactacataaggtttcaatttcttttcactcccaattcataagccccacctgttactgatctttcccaggcgtaatctctgttctaggcttccacgtaatatcttttccctttccatggtaattattccagaaaagaactccagcaagctttaaaccaaatgaagaatgaaaaaggcaaaagtaaaaaacctgagctgataacctgggcgctatttaatcagctttcccaagcttggaaatagcagtttgaatgcagaagagactctgcatttattatccactggggtccctcacattgaaacatccagggctgaagcatgaagaaggaaactctattcaataacaatcccaaataatcaagtactttttcccagctgtccacattaccaaacattcttctcttggtacagaaggaatgacttatgaacaagagcctcgaatggctgagttaagaatctcaggctagatgattcctcccagttgcctcctgtcactcaactcccactttgcacttagtgctgaaagatccagagcaaaggtcagagtgagaggaaaacatgagagtggtcatattttctcctactgaggagaaattagtgcacaatttgtccttttgcaataagaaactaacttttgtatttagaagaaaatgatagatacaggaaagcctagctggaaataacagactctcagttttttattttgtccacttcatgttagtggcaggatacctgatattatctcagaaggtaagaagctaaactcattctgccaagaacctgggtgatgaagcagtggtagaatagacggaggcatccactagaatcacacaagaataggaaagggaaaaaatctcttccaataaaggctgcacttaagccgtgccatctacttctgcccaccttgttgcagctggaacattctcctagtaacaattatagttaatattttaaaaaatctattatatcccagatgacactttacatgcaattactcatttaacatttgccaaaactcactaatcagcaactactgcgtggttgctggattgttctaatggttccagttgttctctgttccgtgtattcaaatcctttgcctggtgactttacagcaagtccccccatgaggttgtggggtctttcttcccacatcttgggtctgggctcacagatgggattttgccaagaaaatgaggcagaagtaacaatggccagttctgaggctaagactcaagaggcctgatgtgttgccatgcccttttatacctgcaccattgccatgaggacacacctagactgacctgatggagaatgagagacataaggagcagagaggcatcactggaatcatcccagctgagccactcgtagatgggccatcagccagccaacccctagacatggaagggggcccagccaagagcagcaaatctgcccagctatcttgagacttataagtgataatatacagttatagaatgataactctatatttggggtgatttgttggttataaaagctaagtgataaacttatttttacaaatttaggaaactgaggcacaaagaaattaactcactcaaggttactcagacagtaagtgacagaggcagggactgaatccaggcagcctaactcaaagcctatgcgcttatctactgtctgacccacctactttagtggagagtaaaataagagatggagaactgtggcaatatctgtgtgtgtgtgtgtgtgtgtgttttcattgttactgtatatctttcttttccctggaaaagtaagatacacatcccttatattagccaatcaaagcaatcattttaaaaggaaatgtgagtagaagacatagctgagatccacagtgttcatctaagtactaacaaataagacattcaaaaaaagagattcacagagatagcactttcaaattaaatattcttttcttaaaatgttgttacagactataaattttaaataaaggtaattatacaaaattggaccaggcgttacaacatcaaactcgttagaatttactttggaatgaaatactatgttatactgcagcatattagtcacatgggtataggacaaaatcacatcaggaatcttcaaacaaagccctcttaaatatgctttctcagaaaatctatattcaataccaaaaataatttttacctctgcagatgtgaaaaggattaatcttggcgaaccagacagccccttttccttaatatcaggacaatatttgtatctagctaaattcattgcatacatattggacactgagccacctgcaaaaacaaaattaaaatggcatatttatagcatgaagttatagctcgcaaaatgctgaatacagtggaaagcatgaatggccatgactgctctagtctaatgaaaaatcaccgtgaaaagcacatgaacaccgacctccctgctcccattattctgaatattttattacataccctaatctctaattctagaacttttattcttagaagataaattttggtttattcccatgacaggctttttttcaaaccaaaagtctcaatctgtgagctctggacttagggcctttacctaggtctccatagttaatattctttgtcacctaatcaataaaattgaaataatatttgttggtctctggctacaaaaaaggactacaggataaacaaatgtaattcagaaatcttctcaagtaaaatttgattttaaaatttagaggacttacagcccttccaaacttccagcatcaaatcgattcatttgtgttagatataaatcctaaactgtaggcacctcattcattaagtatgtatgtcatctatttagcattaatacaaaatattatcactctggagaaaggcataagctagattctcagcaagtagaattattaatatccaactttttgtcgtgtataaatctgcaaggagttgttcctcatggataaatttttacgtggttgtattggaaggttgatatcaataactaattgtactcacctgggttaaatattccatccccttctttccagccaataaattcaatcattttcttcagaaccgcttcttccactaacagaaacactggggacacctcatacgtataactagatagatataaaaaacacttcacttctatgactagagtcaaaacattcctttggtgtcccaagaaatgcacagagttctattaaaccaagtggctgctgaagtgtaggcagtctttggaaatttatccattgaaaatagagaattactccatcagtgacagcactagtcatggttagataaatgccaatagcttgtggcctcagggatctgcaagttgctgcagcagtctttcgagaaaaacctcaattccgtgaggagcaataaaggcaatgcatttgcgtgctatgtattagccatgagcagtggccatttcactctgtggatgcttggaacactgacttggatgctgttgatggtcaaagaaaatccattgtcatggtaaccaagttttatcagattactgccatgagtatgctaacagtcccctctagatattctaagtggagactactccacctgaaccagggcttcctctactacactctctgtgtctgtataaatgaggagtgttttgtgagacatctcttatgtgataattttactgcaaagcactacccaaatcccttgtcaatgaaggatgtgttgctccgggctggaacgctgttgtcagagcattgatgttttagcccctttagagattgccttggctgcagggagctacctcctccagggtcacacccattcttgtggtggtctacacctgataactgctggagatgtaaaggcctagccgtctgggcctaactccagacccctcttgaagggccactgtagttccagagatctccgagcgtcagccaagattgtcatggagcctgcgtggcaatttgactcctatacttgccctttcttgcatcctcctcctccttccccaggtcgtcactcatgttgatcccaagggtactccttaataaacgtcccactcactaaacaccatctagagcagcattcttgggaacccacattgtaacagtcaccatgccttgtttgatatttattttctctctccagacaacttgagggtgactacatatctatgatctccttttcaattgagggattacattaaattgtatctgaataaatgtgtactctaaatatgtaagttaagcagacacatttagatttatagtcacagaatttaatgcaattattttaacatctggaaaggaaaactttggattgaggcataaaagctggtcacctactatgtatcacctactatttatcacctacatatgtgtcaactctacagatgttatgccatcttaaaaataagatagattcagctgggtgcagtggctcatgcctgtaatctcagcactttgggagttcaaggcgggtggatcataggtcaggagttcaagaccagcctggccaagatggtgaaaccccatctctattaaaaatacaaaaattagccacgcatggtggtaggggcctgtaatcccagctactcaggagactgaggcagagaattacttgaacctgggaggcggaggttgcagtaagctgagatcatgccactgcactccagtctgggcaacagagcaagatttcatctccaaaacaaaatttaaaaagatagattctgtttcttaaccacgttatgaagccagtgtacatacacaaaaagtatgaaaaaagcatatatttatgtgaacctacaaatatatataaaatagttactttcataataaaaaaaaaaagtatttagcctgtctttgaaaactggctcaattataaacctaggaatcagcctggagggtggaggaaaagataagatagaacacactcatgggttggcatattttgagtggatggtttagcttagcagcaatttaacactcctttaatctgaaatatttagagatttttgaacttagatgaagagttagaaaacctgggatatacaagaaaagattgaaaaaggtgtgtaattttactgtctctcctgacttaccctcactgtaactgattgtaacctggtatctgctgtcatcactccatcaaaacctccctaaagttgccagtgacgtccatgtagctaatccagtggatgctgtttaggctcttagttgaatattcaacaacatgtgacactaggcatgctctcctcgtggctgccacagctagccttttgtttttttccttctattctcgccattgtaagctgaccctgttcctcctaaccattaaatgttagatgtcctcaaggcccagtattgagccgccttctctccccactctatactctgtcccctaggcagtggttctttatcttggcttcccattgaaatcacttgttgaactttctaaatatatcaatgcatggggcacagccacagaatttcagatttaattggcctgggttggcacccaggtatcaatacatttttataaaattctcaagtgattttcatgaatagtcagggtggtgaatcactgacataggaagtctcatccacgtccaccatttcaattaccataatttcactgataattcttaagtttatacctttcatatagacatcagaattccaagcccatatatttctcagcttagttcctatgcattcttggatattttaaagtcactgcaaactcaaatgcccacaactgaaaatgtaatgcttgctcttgcctccttcaccatatacttgaaaaccagttccctctcccagtgcttatttctatgaatgatatgaccatgaacctagctatgaaagccagaaacccaggcattgtcccaggagtcttctcccttttactgttattttcaagctgtgtatcccatcctttctgttttattttttgaactcattctttcccgctctattcctatctcttctctccaagtccgagctactttcctctctcacccgactaaagtaatgccctcctaacgggtcccctccaacctatttatatttttagagattttttcagtaagaaaatggcacctagtgacttagaaaccttcaatggctttttgttacatttagaaagactcataaacatggtcacctgggccctatatgtctggcttctatctctctctctctttctctagtcttattctccactacagtcctgtaactctctcagctgtacccacactggcctttcagttcatagagaatggcatgctgtgtcctgccacagggcctttatacatgtcattctgtctatttagaactcatccctcaccttatcacctaataacacttattcagtgtcaactgtcatctttgcagagcacactctcctgagcttccaactaggaaaaattgtcccattcatatgaatacttagaacactttgtacttttccttcagatgagagtttggattttacattaatttttgtggaccacttcgattagcatttttataccagatattatgctccatgagggcagagtcaaggtttatttgtgttcaatatgtctctccatcacttagcacagaaaatgacttttcatgcaagaacaaataaaaaattgcctaatcaattttctcatctgttaaatctcattaaatgagataataatgactgccttttccatctcacggtaccactatttaaatcaaatagctatttgaatactgataagtatcataaaactattccattatttgcgatggcactatgcaaaagaaaccattaaatagagatttttgaaataaaatttcatctacttaaagtctctaatccacgtttggtgtgaaatttctatagcatggcacttacacacttggattcaatgcttcggtcataaatcgggccaccaaggagtaataatcaagtccagcatacaattggttgaaaaatcttgggtggtctgtaaatttaaaatggagtattcatctatgcagcaataaaaaaaaaaactactgatacagcattaacataaatgaatctttcagaaaatgaaagcagacacacacagaagagttatatataacgtaattccatttatatgacattcaaaaccaacaaagctatctaaggagatggcggttagaattctaggtactttgtggaaagaattatggattgggaagggacttcagagagcctctggagtgctagaattggtctatatctagatccaggtgatggctccatatgcacagctacgtacaaattcatcatgccgagcaattaagatttgtgcactttactgaatataaattatacctcattctaaaaaaatccaaaacaggatcatgcgcaaggaaaaacatgttgaagacacatcgtagagccctttctactggtcagtgtttgtaagtaaaatctgagttgtcttttaagagctttgatttacttgctcctcttttttacaacccagacccaaaccagaacccttaaataattatttgaacactatttgtccaaggatcacagggtactgcctttttttctgaaaatatcaatattaacttctcacttcatatacatttcactcacagcagagttcaccccaggctatggcactgagcagccttttcatttttcagattggacccatgcgactggcagtatatagatggagtaagatgtgactcactatgcggcttacatacacttctgattcaatttgcttgaaatgcaatcgcctttaagagacaaacaatggcttgttccaattttaatttttttcccccctcctataaaaggtctcataaaggttcttggctttacaccatgtgaataatcacaccatacacccggctaactggcttggcattctcaatctcaggaagctcagcatgacagaacaaagaggcaggaggtctatttctacatttgagtatttgggaatcatttaatttggtgacctctcattacaacttacagcatctggttttagtttattttagttttttttttctctctttaggggttcaataaaaaaacaagtctcaaaagaaaatgtcttttcagcttaaacatggaaaacttcctctgatctggcaaaaaaaaaaaaaacggcattgctacaagtaattttaataagttttttttagttctgtgttaatttatgattgatttccatggtaacatggaaaatatccagtaaactgaaaaatctactgcattaaatgtcattctgcacttttgacatgcactggtaataataagatacatatctctgcttttgaaatgctaactgagtttttgatacatacaccagactttcccaaaggaatataatccaattatttttagccagaattttactatgttctttccactaaacttagtccagtgtcagaatttacaaagtaatgcctgtatgatcttaagcgctagatacctttacattacactgacaaatattttggaagattattctcccatttttgaaacttgttcgctggatgaacaggatattaacaggtaagctagaatggtgcctcagtgtaagattgacatcacattactgcacgtacaaagttcacagtagttatgacatcactgtgaaataatctcatcaaaaacttggaatgtattcatttgtcttatatccatctaagggcttttatttatttgtttttggtacagccagatttgatcaaatagtttggcaattaccaactgccaagagttaatcagtgtcttccaaataaatcatttctgtttatattaaagataccttttgaacactttttttgcatactctgggccatcaagatttaaaatcccttaacaaatttatataatcaaaatactatttgccagtttggtctaacacaagaaatgataagtagcagtgataatatatgatcttgattacaactagtatgtgggggttggcaaggagaagaggatatttacatacaaacactaacacctacagttttcctgtcaacttatctttggccttggcaatgaatctggattagggattaaagggaccattgcaaaaacatcagaactactaattttttgatccagatttctcgttccataagcattgctatactcagctttgagaggctttgcaaacataagaacttgtcagaggtacagatcaaggaagtaaattaaagttcttactagttttgacactgtagtgtatgacatcccgacagagttccaatagtttatggggtggctcgcctgagtctctcatctccaaatcaagaagctgtttcagttgttcaggaggcctccattcacacacctggagattcaaccacaacacaaattgagtatccaccatagccaggtattgagaggatgttacaaacgtggactctaccattacaaagcttctgggcagcgggtgatttaaacatgcaactatagttcagacgaaaagaactattacagtaatgtagatgttgatgggaccaatgaggggcgccatcttagatttgcaaggtaaagggagatttcctagtgatactgatatctaagttgttacatagaataagagtagagcgaatcaaagtttagggaggttctagatggaagtgacagaagtaacaaagatcaaaagtaaaattaaaaaagataaaaaattcggatcctatggcacatctgtaaaatcaagtacatttggtatggcttgaacatggatttttgagaaatggagaggaaataaacaggaatgctgaagcagtttttctctctgtgtgtacccggccctatgcagtctgctatcgacctagcagccagaatgatcctcctaaacttaagccatggccattcctctattcaaatacatctgatggctccctgtttctttcaaagtaaaacctgaggtccttacaaagatataaaatgatcctttacgatctgcttctcctggtttcatttttcctctagtctcatctgggactactttccttctggctaactctgctcttgacaccctagcctccttactgttcttaactacacgagggaggttcccatactggggtctctgcactgtgtgtgccctctgcctagaatgtttttcaaaatatcctcataactgaatccctcacttatttcaaatctttgctcagaagtcactttctcaacaacagcaatcctgactcccttacctaaaattaaaatctacccattacctctatcaatcccctttaacatttcctactattcctttttacaaagcacttatcaccctctaatatactgttacttattgtatcctacataatctccatacaagcagatctgtctttttgctcactgatcccaagtgactaccacagagtctgcacataatagtgctcaataaagatgtgttgaataactgaatggataaacagagataagcaaggctcagatcataatgggctttatgtgacatattatagagtttggacttggctctaaggaagccattaaaatgtttaggacaggggaatgaaaggatcatatttgtgtttggggcaatagctttagttgttatgtggaggttcccaataaaatttgaaataagaggttgctgtaataagccaggcaagagaaggtgatgatctggatgacagtcaatgctgtattaaatatgtagtttttagagatatttaaaatgcagaatcactagaacctggaaatcagttagattttgagggtgagatgaatgagccaaggatcatcccaaggtttccagcttggacacaagattggatggcagcaatggggatagcaggagaaggatctggttggggtggtgtggggatgatgaggtgaaagcaggtttaggacaaggcaccttcagaatatccaaaagctgtatagcagttgatctgaggctcttgcaaaagattgaggacagagttccagggagacactatgataatgtaacagtagttgatgtggctcagagagaacctacagcagggcagaaaggagcagaatctttctgggcatcaccaacacttatgaatgggcataggaagaggagcctgactgtcctgtggagggcacgccagagaggtagggagaatcctaagagtttagtgctaccataaccaagaagaaagaatgctttaggaaggagatgttcaccactgtcaaatactgctaagaagccgaattagatagacttgaagtgctcatggaatttatcaacaaggaggtgttcttggcaagagcagcttgacttagagaggtgggggcggaggccagattgctttgaagtgagaatgtaggaggtgaagaaacggagggagggaatatagataatctctaaaaattttggctgtggaggggaggagagagatagggaagtagccagggagtgaaaagactgggaggctggggggaagcaggaggaaataccaagttgtgcaagtagtatgaaattaaactatgatgctataaccatgacaggcagaggtaaattggaaatgcctgagacaatcaaaaggaatgactactggcgcattcaacaacatggatgaatctcaaatgcattttgttgagggtaaacagcaagactcaaagcctactaaaatactattccatcaacatgacattctagaaaaggcaagtatcatagggaaagaaaatcagtggtttcaggggctagaggaaaggggaggattgattagagaggggcacagaatagttatataactattctaatgaagatatagaacagttccatcatatcgtagtaatagttatgacttctgaaactcatagaaccacaccccaaaggggtaaattttactgaatataaattataattcagttttaaaaactggctgatgaagaattttctgctaatgaaactagcagtgatcactgcaccaagcttgggtatatatctgcaggctaccttttaatggtgctctgttggatctcaaacaaggtaggctaagttagtggtatcaaaacttcacctccttcccccaactctagcatagctttcaatccaacttcccgtgggtagcctgcacatctattacattgtaattgacttgtggttccttaattgacaacttaggatcttaagatcttccgtttctcatcttattagtcccctgtgtgagctctttttttctgggcaaaaaatggtccccttgctgtgttaagtacatcttgtccttttgcaatgctctttccattattgaccttcctgctttcttcctccagaaatgagtaccctaacgccaaactttctcttcccctgccactgccccccaaaattctcacttgccctttacttacattccacatctgagctcaaagtactcgctcctgagtgaaatcccaaaaatctgttccagtctcaaagcatttatcacatccttactgggaccccccgctgccttttctaatgaaaacatatccttccaattagattataaattctgttcagagctgggcctttatattgtttttctttatattctctagggctgaatataaagctttagtcatagctaatactcagttaatatttaatgactgaataaaggccaataaaaaaaactgccagaggagcagtgtactccaatgtaaagcagatccaaagtatttcacaagtacagagaagaacagaaattatataattataaatatgctatctgggcaaataccaaacaccatcaggattttgccttgaacataacttccaaattcatgcatcaatctattttcctactagttttccgaaaggcatgtgatcaaaaattcagaataaatatcacctcactttcaaaatcttttaaaaatgatacttatttctaactaatataactggaataaaaatctcttccttacatccatttgttgataatccacctccaacatgaaaaccaatgtgataaaggttgattcggtaattttaagaggcatatggaatagttaagagtgcagattgtgaagtgatactgcctggattttagtcccggctctgatacttgtgtataatcttgggcaacatatttgacctctttgtgcctgactttctttcccagctctaaaatgggggtaatagtatctgccttttagtgcttttgaaaggattaaatgcataaggagtagtccttagaacatagtaagtattcttaagagtagatgtcattagcggcggttctaatatcaatttgaattgaatttgagcctgaatttgaaatctacaaccaataattggtaccagaaaggagtcagacttaaccacctaagatttctaggctaaatttagacaagctcttcataaggaccttaagataaatttaaaatgtttttacatccttttccatcttttgcttgattttcatgaacaacatgaagagtgtgcactagaaaatggggagcaaagagcattagagagttgcgtaagtgagattagcaggttacttatctatgttattatctagggtgcaggaagtttcatccctgtgcttcatgtccttatgtgattaagctctagggtctcagccaatcttcccacgaatgatgactggcagagtaaggaggcaacccttcaaggacagcaggaattgcctgaaggacagcctacacttttatatctggacatccttttgagacaaaggcatagaagaaataaaaacttggccttcccatttgctttctattcagccatactgatttggggaacatctatctttcccatttctgcaatttcttacaggttttaatttttaccttctcattgacatctgtagctttcaaaaccacctcttccattattagcctacaggcctcttcaacaaatttttctccagcttttgcatctgttgtaggaccattcagcacaaccccatccacaagaacagcattcttcttacttggaatcatctcttgttgatcaatatctcctggaagcaagcaaacaaattgtgtttgagagataatctaattacaccacataacaaagcacgggacaaaatgcatcactatcccagcttcagatggcacatcttttaatacatgaaggcatcatttgaggtgttgagctgacaatttcttatgacacaccatggtatgatagttaaggaaaattttacaaagaaagctcacaatttatggattaagtaaatctaccttattatatatgtcactctgtactgggctgagttagtcatggagtatatgacctcctaattcagtgcaatttcaggtctgatggggaaaggtaccattcacatacaattcccatgctagatggtgtttgaagttgaaaaaaaatgttttccataattagaatgctgattcacaaagcaactgcccctaggagagagtaaatattcattggcatttctacacatgcacaaatgattaagtgatttccctaatcctttcctcagagacagccgtcactctaccacaggagagttcgagatggaggaacaggagttaggcatttggagaaaaggatgaggagaaagcccttcagattttatctagaattaacaccacctctatgctgtcagtatccccttaaaatataaataatacaatatcatacaatagtggttttaactttcagaatctggtgcattgagtagacaaatcctataattaaggtagcaagcttttagcttcatttccttgtacaaagtcctttagcatttctgagccctaggatgaagctttgggcagagataaagaaaatagcacctgtccttacacaatttattttcctcaaggaagagataatgcatttccagattgaaataacaaattgaattttatgaagatccatcttgtattggatgtatctgaattatcgaagtatctaagagggatcacctggtcaccttcaacaaagtgaatattgaaatcttcaaaggcaaagagctagctgcttccttcttgaactagcacacatgaatatgtttctccaaatgtatgtcccctcttcctttaggtgcgtgtagctgttggccaatttctctatgaactagattacaaagtttacacaaaagttgtatttttcattcttgcagcatcttgtttagcatcagggagtgtggaggagaccaagaaatgtaaatgtaacctattttactcattcttgcagtcacctttcaaacacatgtacaaagagatcttcgtaaacataagcccatgtctgtttcacacacacacacacacacacacacactctctctcacactcacacactcactctctctctctctcgtaatttgtcagggataccatattttcccttttaacaaatcattccttaaaaagcagcagcgatataaacttgtcactaatcttaattgtatgttttaattctatgtttaaatgttcctctatattacagatactgctttgtccctgagagcccctaatttttcagccattttctacatagagagtgatagaggaaagaaagcagcacaatgatttgttaagcctgtattaaatgcctttaaacttttcaaccttgcagcttaagcacaggcaaaaggatgagacggaacatgttcaagactgtacatgccgatcattgactaaatgttaaaagtcaacatgaaaatctatatctgagaagaaaggttactgcctacccaaaatagccctccacaaaaataattctggcaactcaatccagatattcaaccaatttccagcacaagctttgattcaatcacattctctttttctaatcagtatgtttctccaccttataatgtatatgttcatttaattgttgaaattgacagaaacaatttttaaagtacttttcagcactgtacctcacacagtatcttctattttaaatccatcttaaatattccaatggtctacaaaaaaaaacccttctaaatatatgtatttcaaacacttctactcttagtgagggctctaacaatattaacatttatcatttcttagactccaccttctcctcaaagttaaacgttctgataaaattctatggctccacaaacactttaattctgttattggcaaacacaaatggtgtctatgaaagcaccagataaaaatgttacaggaagatcccccagttggggaaagatggaatctgcagcaaaggatcaatcttttgtcctctcactgaaaaagaagccatttagagctccaatgaagaatgttagttccagccctcactttcacatgaaaggaaacatttaacatggtttagggccaaatattgaaaccctagaattgagcttttagatggaaatgctctgcacctgaaggtactttcctctcctcccaaattttttaggccctaaaaatagagtaagaaagagagcaattattccaggaactctggttatgtgagtaggcagtgctattattaagcacgcagaaaaagttaagattttttttttttaacctcattagtaggatttcaagcttttattacccagggaataacagcagctctatagcctgctcattatgtttctctttctctttctctcaccccgttccgtgtgtgtgtgtgtcacacacatacacacacacgataaaataaaaaatgtcaacacccactcgtaaccagaatagcagtgaaatttaaattatcactgtcttcacaccaatgaattaaaaaaaatccccataattcacacaattatctaggagaaaatactgtaaaaatctatacagaaatgggtctagatgatgtcttttctttgatagacacattttatttttatagccagatgtgataatgtgcctctttctcccccagcatttgtccaggtcagaaaaggccctctggagactctagaataggtcaagctgtggtctcctgaggaaggatattcagaattttcattctaactgctagagtttatagtggctcttaatgaagtctttcaatttgaggaatcttccatgaagactatacctaggatatgactgcttttcatcacccccacttttactaccttagttcaaaccaccttcaaatgctagggttactgcagtagcctcccaactaaccacctttcttcgccctttcccctcattttctgtggactattctcaacacagtacctcctacgttcccttgaaaagataaatctgatcacatgatgactcctgcttaaagcattcaatgactcctcatcaaactaaaagctaacatccttctaataacctcaaaggcccatttccctattatctcatggacctcaaacctcatcttgttactgtcctccaagctcacacagctctatcatctgtggtctttttcaccatgctgattctttccttaaacatcagtttctcagggaggccttccttgactacctcatatgaagctgcaatcacctctctgcactactttctctgctttgattccagagcagtgactaccatgggatatataatacccacgtaaattaatatatatatatatatatatattttttaatatctgtctctccaataaagaaaggttaagctctgtgagagcatgagtttgtgtctgtcggtttcactgttatttccatagcacccagaaagtgcctggcagtttgcaggagtttgatgaacattttttgactattaaatgaaagttcttcctggttcctttaaccaaccagtgataatgtcttcctcccttgagatgccgtcgcaggttgtctgtatgcctttctgaactgatagcacagcaaggagactggacctgattaagcaggggaaacctttggctggggatgcaatagacatagaacacagttaatgggctagagaagagacagtggaggctgaaagaaccccgggaacagtcagcaaggcaaacctgggtttctgttctcttcattattaaaggaaactggctgcaagaccctccctttcctttcctctcgattcttgttaccgcagccactttttctgtgcccttattttatggtagtcatttgacttctagaagtcagcgcacggaccacaggctcactccagaaaccacacttccaaatttgaaagccagtcaattcctaaagactccaacttctgcattttttaccaattcctcccctccatagcttccaaaattctgtataggatcaacttttgctttgttcagagagatacattgttctcccttgattaacaaacaattcagcttcaaatattgtttcagattttgagagatagcctcttcctctgacatagaattaagtgaattaatacagataatgccttaaaacagtgtctggtacatattgggaactaataaaagttagctaacagtagtaaataacaacaatatttattcaatacataaatgacaccaggcacggtggttcacacctgcaatctcagcactttgggaggctgaggcaggcagatcacttgtggccaggagtttgagaccagcctggcaaacatgatgaagccctgtctctaccaaaaaatacaaaaattagccaggcatagtggcacacacctgtagtcccagctacttgggaggctaaggcacaagaatcagttgaacctgggaggagaaggttgcagtgagccaagatcataccactgcacttcagcctgggcaaaagagtgagaccgtgtctcaaaaataatagtaataatagtacataaatgcataaaggaaacttgcatgtgatggtaaactgtgacaatagaaaggggaggtcttctcagattgatcaaatgaccagggtaataaactctagaccaagtggctggtgagttatcacctctggaagggcaggaagagaggaccacagtggttgggggttcccctgtgagaagagcagagcttcctccaccatgttcagaacgcaagatggtagctgagtagttcagcccacactgggtaggcagcttcctagaccttctgccttgttgctttccaccttgccctgtgtttacctgtgtagaggttttatttcttataccagattataaacctacagaaaaaagccatgtctcattttactgaccattccagaaacagagttcagcaactggctttcaatagctctctgaggactgactggctgactgtatatttactttggaagtcatcttatctaaccttttcatacaatccaataattccctccacaacctgtggcccagacatgagaagagctgacttctagtcccacttgatcactcccaagttctctgatcctgaaataatacaacctctctgtgcctgttttctcatctataaaaattggagcccatctgaggaaagtgatctgctagcttccaaaaaattcctgggaaaattaatgaagattcagaatccggattcctacccaaaaggattctatgtggagcctaggatctaaaatttcaggaagtattcccatttatattaataatactgaaatacactaatatgcagtgggtatggaaatggctattctgggtgacctctaaagtccttccaaaacttcaaatcttcagttgtctagcccctctctctactcctttaataattatgtatttatcttaaatatgcatcaatctccgagaagttaagaactgaaaaattacaatactacatatatatatatatatacacatatatgtatatatatacatatatatgagagagagtacttactatgtgccaggccctgttctaaaagttttacagatttaacaaatgtaattgtaacaaactcgttactcagtttttcagatgagaaaactgaggcacagagagggtttaattcagttgaattgccttgcccaaggtcacagaactagtgagtagtgaaactgaggtaaatttttactgagtactaaatatttgctgaagttctatgaaggatcaatgagattctgctttatgggtatctaccattagcaaggcatcattagggagttaataatgacagcaagacgaattactgtacttgggtaattgggggcctcaaagtgctgaataacagcaatagaagataataagtgtcaagtagtgccacgtggaagacaccaataaaatatgctgaatgtaaacaatgtagacatttgaaattaagggttgtggttataggagaagctgaggtgtcagggaagatttctgaaattagaagacctgccttctctttgaacatatgcactaataaataatatacttttaaaacctcatcacttctgaagtaacaacttcattgacagctgcccagacctcccaccttgtcactttcacaatggtcacaaaacttttcctgagagtgactccaaatatgcatttctgtcatgtctataggcttttatagtaaatgagttaagtacatggaatttttcttccacaggactgtaatccaaatatgtgaagactttttatcaatgcttttaattgtcagttaaaactgctctcagttttttcagtggtttccgatagtccgtggtctgtagtctggaccaatttgcttttatcttataaaatgaggcatctcacaaaattccaggtgtgatctcaccaactctcaacatggtgaactcatatttcccatgctctggtcaccatgatttcattaataaagcttttattgacaccatagtggattccaaagcctgagctttaagtcctggcccaaattctaactctgcttctgtgaccttactcatgttatttaacctctgtgtgatccgtatttcttttctggcaaatggggaaaacagctatgagtcattgaaagggtcaaatgtggtaatgtgtgcaaggtactaaacaaagtgccagggacagtgtaaagaactcaataaatgataactattaatgagtttcagtctatatgaactctcttttggcactcacgttacactgttggctcaggtagaagtcataattagcagtcttagggttttgtcagaaagtctgccagtaaaagccaagtttcccatccaagtctctttaattgttcagagcaagttagcaatagaaaaataatgtttgctttcaaaggacagaaatgagaaacaatgaatcaaaagtgaatccagacatctggttgggggaggccaaggagctcttcagaaagttagtgcaaagacgctggggaccaagggaggcagaagggtcaggacttagagaatcccgtaggccggtccaagagagtctgagaagcaaagtttaagagctggggtagtattaattaataaattaataagagcctcacccagcctggtgcctgtggatacagaagtaaaaaacagtctctgttctcaagttgttaaaagtctagaaagcgaatatttaagaaaccagggcaaagaaaaattgagatttaaaaaaactgaagatatattttctcttctggaggtttctaagtcaggcatttcttccaggctcaaaagaatggatgcctaatttacctgatgtacctggtacatcagcctcatagattgtttgccacacttttgaatttcacactggttttaaagctattttagttgtcttaaaaatgacatgccaatgagagcgggtaactgtgaacaacctacaaagaagatgactatgggaaatattaagaaataacaataacacaaagccgtgagaacagaagctctgaagctttgggtaatggcgacaaatgtggcaacttagtccctggatctagccctgtgatttgatagaatcataaagaaggcttagggattgaaccatttccacatccaatccacaaacatgaattcaaaggagtaaacagaaaactatgtttacaactttgtcagcaagagatatgggtatctattttattttatttttttttgaaaagagcaagacgagaattttaatcatttctttagtctcatcttggggtcaaattctccttagctgaaatccacagtgagcagatacttctcttactcatactttcatgagatagtcataaaatattgaattgctactatgttcaagacattagggcaggcactatagaaaacttcaagaccaaaaagacacacagatggtgaccccaaaatccaataagggaaattagacatgtttattaatacttgaaatcctatccaaaaggcataaagtttgataggtgaagtcagataaaacatactgaaatttcagagaagggtattgtttctcaatgtgagaagcaggaagtccttctggatgaggtggcatttgagacagacctccattcatccaatcagcaaatacttatatttagtgcctattatgtatagaactctgtgtaaggcatttgaggttgagcaatgaacaagaaaaatttacatttagttggggtggataatatatgcagttaagacaaacagataaattattaaaataatgcaggctataatgttctaaaggaaatacctgaatgacttcatagaataaggacaaggagctattgtagatataatttggaaaaaatgtttctgaacagaagatatctgaattgagttgtaaaagagaaggagagccagacacgaaagatatggaaagagaatgatccaggaagaaggaacagaaaatgcaagcaatcaataagctggcttctttaagaaatggaaagagataagtgtggcccaagtgtgagggcaagggaaaggaagggtgaaattagatttggaaatagggactgggagcagatcaggtaaggtcgtattttactctaaaatcaacaagaagccacttaagggttttaaacagaggagtaacatgaactggcttacatttatggaagattcctctggatgccgtgtagagaatgaactgtcaaaagacagatgtggaaatagggagactgcttaggtcacaactgtagaagtccaggcagtagacaatgggaactttggtctggatggtggcagacgagatggagcaaagtgctgcaacttgggagatatttaggtgataaagcttaaagaacttgcggatagattggatgtaggggtcaagaaagcaaaagaatttaaagtaattcttaggtttgagacccgagcaatgagacagatggtgactagtgaaccctctatactgatctggggaatgctggggaaaagcaagttagacaaatgtgtggctgggacataggaagatcgacattttgacaaattcataggaattggtcatgatgacatagagacaagattcatgccatggacattcatgacagaaaaagcaacatggactaaggcagaaaagtgtgtgtgtgtgtgtgtgtgtgtgtgtgtgtgtgtgtccaagaaactcaagtacttctgtttgtccaaggggcagggtctgtaaatgagggaaggagcttttgagaaagaggcaaggagaccaaccttgcagggacttcagtagaaactgaggagttcagctgttacttactgagtgggcaataggaggccactgaaagctgttgatgggataagaagactgccttagaaagatgaagcgggactggtgtaaagtttaggtgtgaaaccaagaattgaaggaagagagaaatgatggcaataatccaggccagggagagggaggaaatgaactaaatagtagacaggatggtaggtttacattttattttatactctctcctacaataccattactgaatttgagccaggtatcccatatctttgtaaagagttctacaactgtcaatggatagacagcttttctctcctccagtaagtctatgttctaaaaatgatcattagataaaaagtgacagaataagatgggagaaaatcactctgtgcatcagcacctttcttgaaaagcacagatgaacatgtaatatttctgggagggaacatgttcccgtcacccagagttttacattatgagactacgttgtgttagaatctcagataccactcagataattctgattctactgaaacaccaaggcatccccacaaaccaaagagccaggtccataaacaccatccagcttctgagagaacgtgctcctcagaagggagtctctgaaacagccagaaaaatagctggcagtgtcctaccaatagccaataaatacatagtacatcataaaccctgcttattttaatttcagtaatgtttttctttcactgggcacaaggccaggaattagataacctaatcttttcaagagagtagatttttcagagacacttactcctattgcttgagtaaatattacttgataaggggcatgacgtgctgcaattgtatatcttagattgtcatattaataaggcagctctccaaaccacctccacccaccaaaccatttctaaatcttttgaacttctataatgggtacaaattcagcttgaaaacacttatgcaattgggctccatgaaaaaaatttgacttaacatagccatttagtaaattttatccctgtccttcagtcccagtttggagcactttactcgatcatatcctttaatgtggcttagtggtagctactgcaccacagagcagtattttcctcaggagctgtatcttccttcttctctccattaaccactgtcaccccccatagtcatagtttctgttggcattttcctcctctgacatcttggctgtttgtcctttcttattcttcatccttttcttgtctatatacatttataaaacaccaggtttcactcattgctttaatggtaacttctgtgttttctgagattcagggctgagtaaatagaaggcctgtttttagtttgcttgtttacttgaggccatttttggtctaactagcatcccaactagaaccacccttcccctaggacatggtcttggtgatactgtcagttaaatacccttttgtgggtatctccaagttctaagttttccagatctcaagtcaccttggttcctgtcttatttaagacctaattatttatctttctctaattctgtgagctttctaagatactctcaataaactcccccttttggtgagcaagagtcattctgcactctgtgaaactagagagccatatgaatactctgagtagcttggattctgtagccatttccaactgatgaaaattaaaaccaactagacacaccttactaagtatactctcttgaccttcagagtctctcatctatttacactgttttccaaaacttggaggtcaaccagttactgtcagacaataaatatgctgttttttttctaactttcttcccatgtataattctggatgcttgaggtcagtgtgtatagtgcagtcatagcaaaaagagtccagggcagtgctgccaaaaagaaatataatgcaagccactgacacaagccacctgagtaattctatcttctctagtagcttttctagttgtagtgtggcataaatgaaacaaaaatataattgcacttataaaataataatggttaacatttaatggatacttacaatggaccaggtattgggatatacactttatatatttatatacatatatatgaggttatttcatttaatcctcataactgccttatgatgaagatatctttattaactctattttatagataagaaaactgaagttagagaaagagaattgcccaagtcatatagctagtaagtggtggagccagaattcaaagccaggcagcctgattccagatgccatgttaataattaccatattctccttttttccaaaaaaggcaaggaagaacatattgctttctgtgtcttatcaaccacactaaactatttggatacatttttgtactcctaaagcaataagcgattatcttagaagtatgtattaaattgcaatgtgttacaattaatatatagttttaaaaccaatttgctcaagtgttgactacaggactttaaatgaattccatttaaccagcaatttaaatgaaaatttaaataaatgctataaatgggtgcctcatttgcatcatctgttgatttactctgatatggggattatctttgcccagggttctgcctccttagggctttggtgaatcattttctaggtgaacaggaggcacttactctcagctctcttgcttctcaatgcacatgttgtaacattcacatgtggccaccttcagatacagaaaactgtacttaccaaattcctttagagttactaaatgtgattggaaagtacatattgagaagctcattggaatggcagtaaaacctttccaaggggtacatttaaattaaaacagatggtccaaactgccttctagggagggaggacactgttacctgcaagaaaaatgcattgctgagtagggtttgcaaatctggggccagagcttgaatttcttagtgaagtaggtagtgaagagggtgaggctgaaactcatccctttatgccacacagattcagcttcacctctatataaaattggagcaaatgtcctaaaaattgtagcttcctgggagtcatcacagtaacacaaactacattatagattgtaccgctggagtggcaaatgcaggtgccctgaggaatgcccacacatctcactgctactgtaatgttgagaaatgaagtactcgcagaacactgcctaacagatcatagtgacactggcctgggttattcctcagctgaaactcactgagagatgggtttggaaccatctaggatatgggccaaggatgtttttggccatttatgtgtaagattttgggatcttagagctttacaagcacttacagatcagttagcaaatgtcctcatgttgaatttgagagaaccaaggtttgatgacacagagattgcttgaagcctgtgtaaccccttctaaagattcaccagatccactaagtgttatctacattccaccactcgtaagcatctagaacctatttcatataatcgtagctagcatttatttagtgcttactctatgccatgtttttgtaggtcctttgtaaacagcagcacatttatacaaaacaacaactctttgaaaatacaaacaactaaactcactctggttaagtaaagcagaaaaaaacctgcttgaagggtatatcagctgtctatagttgtaccaaaaaaggaacccaaaatttagtagcttaaagcagcaccaacgtacataattgcttcggggtaattctggtcttgcctgggctcactcacacaactgcatccaacctgtgcattggctcagagctcagctcagccaggaagattgagatggctgggtctttctatgtaggcttttattatcaaagagataagacttgtcttcctcataaagtaataccagctttgaagacagtgaaggcaaaagctacagcacctcttgagatctcagatgatttgtcataaatatcacttctgctgtctagtggtcaaagcaagtagcaaaagcagccagactcaaggatatagagaaaaaaaaaaaaaaagctcacctcttgatgacagaaggcagttgtcacatcattgcaaagtggtaagcatactaggaagaaaggattctgaaaccaattttgcaatctatcatagtccagtctctgatcaaaattcatattcctctcatccacaaaatatcctcattcccatatgaggaccttccaaaatcttatctcattatagaattaggcttgaagtccagaatatcgtggtctgtgtcttgtctataggcagacaagactgttcagttatgttcttggtccagagacccctaaactaaaaacacaagttatcagatgtcgcacacaacatacaatagtcatgcaggccaggataatttctgcagacactctcacgaaagaataggaggcagagggtaatcactgtcttacagcagttctgaaatcccgctgggcacatacttcacatattaaataggatctgatttgccctctcgggtggtttcctaatccagtattctctgtggcccttggctccacactctggcagaagtgaagcagtggcccagcctctctgaagtcaaatgccgtgatgggtagatacagacataccagcatattgcagtttatcctcactctcttctcatctagatgcttggttattgatcctagagatatcattcacacacaagaaaaagcttctccagcccatttcactatcacagtttggcaattggacacgcctggattaccagattttcctacaagctccaacttggccattcttgccagttcctcaggaagctgatccgtgacttttctctgatttccaattctcccttatgaatgttttcttcagttcctgctacaattgtgtgtaaggtctaattcctataatacattccatattctataatgttctatacatataatatgttactgtatttaatcttcacaacagccatgcaagttacatactaacatccccgttttataaatgaggatattaaatctgagagaagttaagtaacttgcccaaggctacacagctagaaggtatcagagatcaaattcaaataggtctatatgattctcaaacctatgattgtaacccctattttccatttatggaaagagatgggatagggacagtaatgtgtactgataaattggtttctgaagaaaaggctctgattggtagcattcgcctatttctatggtgtaaagacgccgatcatggctaatttcagggccaattttaaaactggctcacaacatttctgaatatttaacacttgtaatgaacaagtatgaggtggtttcagcatgcctctgcatggggagccaagaaaacaaaagttcatcaattgaaaaaataacagaaacggagtagagtgtttcttcaggtgtctcttccatgcacaggctctctaatttccaaatgttagcatctcatatttttgcctgcagcctattttggtcagaacctactcttgcccacttacatgccaagtgtgaagatctaaaaaataaatatccatagctcagcatccttcaaccaataagtgatagaaactgatgtattaatagccaactttcttgttcttcacatgtggtaacactaatgtctgtcttcttcattaacacccagagttacccagcaggattaagctttagttacccacagtgagaaataccttactttattatgcatcctctattggctgtctccctgaaatcaccttacaaactaactaaccacactctaattcttgattcagagtctgattctgaaaaatctaacaaatacctattattttttgaatcccaatggaccagaaagacactgtactaggcacttatattacacgtttttggacaaatattcatagcaccctagaaggcaagtatacccagttctacaaatatggaaatatgaggatcagagaggttagttaactctatggaggtcacatagctgatatagtaaatagcagcgctgatattcaaattatgatcaattgtaacatctcttctctttccatgaatctatgcagcctctctcaccagaaagattgaactaacacacatgaaacaataaaagaacaattaaatgctaagctgacatattgtattgaacaattttgggcaaaactgtcatcaaacttatgttccgcaattactttctaaaattctcttttttgtgccatcaacttgaaaaataaggccactgactaatattagggaatccaatttttcataagttttctttatcctctatcactgcatcatacaaattaggtactgaaataaaactgagtgtcatgacagaatataccatgatgaaaatgcatatgaaggaaatacattgcttgggtatatttttcggcccacatagcatctgaaaaatcagatacatcataaaataccaactaagtctctattgattttgtaagtcaacacaaagtattaaaagatcaaacaacacagcatacagagtgctgaaatgggaatagtcttatcagctaacaacatcagcaaaggaaggactttgatttgacttttgtctgttaaaggggcaaaatctgaagtgtggaaatttaagatggttaatggtgtagtattaccatatagattttaatatttaaccataatagattttaatatttaacagtggcttgctgtcatcaagtaatttagatagttgctctacaatatttaacatgaagaaggtcctgaatgctgaaattattagcactacaccaaaaaatctcagatgctggtagaaacacacataaattccaagtatgatttgatcagtgtcttacaggttttgtttcttacttttaattacctgtcctggtgatatgcacaaaagggaaccctctggagtttggggtgagagttttagccctgactctggcccccaagtagctctgtggctgcaagtactttaacctttctggttaaatgatactctcagttaaataatgctctacaaaacaccttgtcactctaacaatgattctatggctaaagcctaattttaaaattaagttcttatttacgtaactaacaaagatcacattctaccatttctaaaagtggtccttattagtgctcttcagaaccataaatttctaaaatcgtccaggaccttcatggaagtagctcagggaaggaagtgatggagaacatgagcaagtagtctttttggcccatgaggcctactttaggtatagaaatgcaattttaactgaagtatctctgtaaattattttccttaaacaaacaggctggaatgaatgcatgaatactttggcttaaattataatatgactgatagacatttgatacccatctcttttccctcttcataaaatgcataacttatctactgagacttacttatcacaggacactccactcagaggcctgagacccagctttgaacatatttacctttggcaactgcacttatccaaagacagtgccagtggcagtggcactagctgaagcagtcaattccatttgttttaagcgtattgtggtgctatcatttttatgacactagggtatatagagaaaatatagtatccttattatgttctttaattaatcctgtcttccacatgagcccacattgctgaaaaaaaggtaacaacatttattttatttagtccaatctggttaaaacatgatatatagtaagttaaacagttcgtttaggcaatgttctgtttaactgtgtaaacatgtttgatatctcagatttccacttctctgaatacttttcttgatgacttctaggtatgtggggagtaaagaatgtctcactcaacctcagagtggaggaagagtggtggagtccttggatcactgcagtgtgtactgactggtacctttgtccctgggcaatctcacttgtctacatctttagagcattcatacctggctgtcatgtgggatgcatactcatggcttcttatctctcatgttagtcagagactggggttctctctgaatgaggtggtctcactttagcttttggtgatggtatagacatttctgggcttatgccccatccttccttggctccccagtagagaaaatgcatcccatagcttttgccttcatcctcatcagagaaagcccactgggaggaccaagggtactcaattaatctaccttcctctgaggacaaaaaggcttttctgaatcatttccaccccttgaagagatcaatacaggctctccctctctatcctactttagtgagccatcactttggctttgataagtctgcaaggtgatctcctccaagagaagctgataaaggcctatgttgttgcttaccatatttccataaaactatcatataaccatccactgtctctccacccctgcttccatcccaagtaataagaaatcaagaatgtgaatttctgcactcgtctctcttgcttaatccttctttctcttctcattgtcacttcctgccagaaatggagatttttccgtgactttgcctgcattaaatattactttttcttgatgctagcctcatgggtagccattgaaggtgcacaaaaatatcttttctgcaccaggaaaaaaactctgtaattttgttctctaggcaaaattggttaagttaaagggaaaataaaagaatgtagaaagcccaaggcaatagtcggaatgataaaattattgttttgctttgaaactcctattttgactgcctgaatcta

SEQ ID NO: 37 - DNA, 13601 bp, Homo sapiens
ttcattgtttctatttcttttgttcctttgattatctttcttagaatgaaatccttttttattttccactttattagcttatttttacaatattttgcctttacttttagcctaaaaattacagcatgcttccttgttttaatatatttatataaattagtacatttttcactttaaacaacataaggaccatagaacttctctcctcacttgccccactattaatttatttttattttttcctaagttcctagcttcagtgttatattgtcatgcattttaattttatatttatctaccagtatcattggtttttattcctccctgtatttctgtgttttcagttgcaattattttcctttgcaggaaaaaaactcactttacttgaagctgctgacaacaaattctctcaatttttttgatataaatttttattttctttttatttggaggatgttttcttttaggtacagcattctagtttggcagttttattttttagctctctagtaacagcatcatattatcttctagtttccattgcttatgttataaagtcagctatagatgacattgttgctgtttcaaagataatgtgccttttgtttaaatcaaaatattccctatgtatttgactttcagtaaattgaggtttcatttgtatatattctgctttaggtacatagttccttttaactttgagctttcttgtctcattattttgggaaaatttctagccactgttttcacttaacgcttttgtttccttcttctcttacctcacatcatatcatcttacctaacctcactttctcttatttctctctttccttttatttgggggtatttagaagagatgctaaaccttttgatcatgtctaataaatcttgtatgctttgtaatgtatttttttctgttatctactctattttctgatgactcatcttcctgttcactaactcttactctatgttcttaatgttatttctagaattaccatgtgattcatactatcaatgcaagaagtctgctgacagtatcgtataccttgttgtatacattaatcatagttatttaaaaacatctaaaaagtccaataacccttgtttttttttatcactgggtttcagtgacatagccctgcatccttttaaatctgctagtttttgagaaaatgttgaatacagtgtatgaaaagttagaaaggtaatctgagattttttaatgtaggtattttcagccataagggattctcttttgtttttaggaggcaggagagtaggagcaaatcaatttttttttttttttgagacagagtttcactcttgtcgcccaggctggagtgcaatggtgcgatcttggctcagtgctacctccacctcccaggtttaagcgattctcctgtctcagcctccctagtagctgggattacaggtgcctggcaccatgcccaactaattttttttttttttgtatttttagtagacatggggtttcaccatgttggccgtgatggtcttgaactcctgacctcagatgatccatccgcctcagcttcccaaagtgctgggattacaggcatgaaccactgcgcccagctggagcaaatcaatttttatcagcctgtgataagattgattcaaagttggatttctgcctttgcaaatgggcttatttgggtttgctctaatgccagttgaaagcctgaagtgtttaccgaagcccatcttctttggcaggtcttgaactaaatgtttgtctctgctacccatgaaactggcaaacctccattcagcttcttagcattttggctaaaattaaaatatcagcaaatgtgtagaaaagtgccaagtgttaggctcccctctcagcactcctcttgctttctgggatcttggtgcctcaagttctggctgcattggtaaacatcaatccttattttcacttttcttatcccaagatactgcccaaagctctgattgacttctcagtatctggaccctttacataaataagcaagggaaaggtggcacagaaatttggcactgcttggtataattcttctctgcaagttcttggtttctcaagggctggttgctgaagtagttctttaatattttataataattaaaaccatttttaaagtttttataattgttcttcgtgatctgttttgtcttctataggccagtctttcttattggattatagtgattttattaggctatcagtaagtaaacaaggtattttttaaaggagacattgaatcactctataaaatatgaaataaactctttcttgattaaagtctttggatacaagctttcaattctttgcataataattattgtaaaatatgataacacatgcttgaaaatgaaaagactaaaatataaagatttatttgttctatcccctgaaaagacagcactgattctatcacacacagatataggtatttatcttcctatagatcatacctaatattctcagagttgataatatattagagaattataatgcatatcatatatgtatctctcaggttacagaaatttcaaatggtgtagtaaaattaattttttgaggtccaggagattatcagattaactgaatcataaggtgactcacaaaatatatgagagtaaacaattatatatagtagaaaaatatatctgaatctgcattcatttttgaactatgtatttactctacctagatgcaaatcttttccccagtctgcctgtttcccatattattcccatattatatgtaaatatttctatatagacatgtatatagaaatatataaacatacatatgtatcagtctgcatatttatgtatgtgtgttagtctgcctgaagctgctataacaaaacatcacagactgtgtagcttaaacaacagaaatttagtttctcacagctctggagtttggaagtccaagattaaggtgccagcaaggttggtttctggtgaggcctctctctctctccttggtttgtagaaagcaccttattgctgtatcctcacatgatcattctctgtaagagagagctcttgtctctttaccaactaaaaaggacaccagccctgtttgcctaacaaggcaaatttccttagatattaaggctcacgcataatcctctttggtctgatgcgctgccttttgggtccactggggtaatagcgtcacctcccctactctgcacagaagccccatccctgtggcctgggcagccctgcccctgaggtactgggcagtggcattctgccctgctgaaacccaggaggtggccctcttcctctgagaccaaagagaaaacacctttgccttgttgggtatgtgatgggagtagcaactgtgctgctctctgaatcactttcagggctgttcttcctatttcttgaaggataatgcatgtttgaagccagttaattctattgtcttgttctgcagagtcccagaagtctgacagccttcctttattacatccaattctctctgttttgtttattccagctgtcagtgcttctgctgatgtaattccatctccgttcctgtcctcagcagagatggctgattaaatccataggtaatctctttaaggagcaaatttccagccacacactttgtctctctagaacatgctttccactttttgcaacatagttagtctgataattttccaaaacttcaaatttccagccacacactttgtctctctagaacatgctttccactttttgcaacatagttagtctgataattttccaaaacttcaaatcctggttccatcttgcttaaaaatttcttcaatttgtatatcttctctcacattttactctaagcaataaggaaaaatccagcctcaccttcaacactgtgcttctacatctcttctgccaaatatccaaggacatcactcatattttaccttccacaagagactagaacacaattcagtgaaattctttgccactttatggcaagactgcctttcctccaatttccaataacatatttctcaccttgagacctcaccagaagcacctttgttcatgtatctaccaatattctgtttaggataatataagtattctctaagatgagacattttctctaaagatcttcttatttatctgtatatatgtatgtgtgtatacatatatacatatacacatatacatatatgtatacatttatacacataaacacacacaaaaattctaaccttcagtctgacatattagatgggatctttgggaggcaattaggtcacagggtggagccctcatgattgaacttagcacccttataaaaggaactcatagttctcttgccctctttctgccatgtgaaggtacaagaaaatggcagtccgcagagagcactcatcaaaacctgaccatgttggcacagttatcccagacttccaggctccagaactgtgagaaaataaatttctgttttttataagccaccttactctatgaaacgttgttatagcagctcaaactaagatagacagacagatagatacgtagatatatagagagatgatagcacatttttaactggaaacatcatcatctttttaactcaaaaaagtaaaagatgcattcttagtagaattattcttacacaggcaagacatctgcctctatcaattcaaatgtatagtctaacttcagcaagaatatctctgtaggggtaattgtaatatctggtaaatagtaagcataatttatagcttaagagagatttacactaatttatacttgaccagaaattaaaaaaatatgtcaatgaaaatattgttacaataaacaactcaggaaatgggaattgtaaagctcagagcatggctccctaagtttcatttaagtaagatcagaatttttggaatacttcattttaaatcatgcatattcagaacactggctaatggaataaagtttagtaatatatttaaatatgcagtctcaaaaatgttgtcactatgaaacatacaaaaacaaccaggagtatttaacttgaatacacagtctaagtagatgtacatatacataacccattacaaagtcctaaaaccgaaatcacttcattttatcagtagagtctgaaggccattcagtcatttgtttttcccctgggatattagcactattgcaaaacccaaaaagaatattttttccacaatctaatttttttgactaatctgtttgactttctgacattacatttgcattttttagtaacctctacagttataaaacattgctttttagatgaattcataataaaaattattttaataaaccttatgatatgtttttctcgcattttcattgttcgcatgcatagaaattgcttcctattccatcagatcttctcattttactggggtatttttaagtcagtttgagtagttgttcataaacttttatttttataaattgtgacactcttgtgggtaaaatttacactttaactaggaatgatggttcactatagaatgatgcttttctgacagttgttgatttgagagcatgtctctgttaactttaattccatctctttttttccctgtaatgctcaaaatgccaatacatcttcatttaccggttgaaaattcctcttcccaaggcaccaagggtctactaaagagtatgtcactaaaactgttgcatttttgcaagcttgggcatcacatatggctcacgctagactcagatagctgtgtggagcaaatgctcaaatctgtgccagaatttgttcattttaacatcactgggactttcaaagaacaaatgccatctatgtgaaaataacacactattaaaggatttaatagcgttactcataatggttaccttaatgataatgctgaattgatctattctgaaatttattccagattaaaacatcttgatagactgttgctgctactgctactgctgctgctgctgctgcatccctagatttttcttcatatggctataacttttgatatgccaataggaaccatatcagtgacagaagaataaggatgctcgtggaatcctcagggatagaagcagcagtgtgtagcagctggagtatgaaggcttatggcagaggcagcagtgagtggaggcagagacaaaaaggaaggatccagggtaatgcaggattagcaggagagatgacaatgttaagggacagtttaggggaaaaagtagaattttgttctaaataagctgcatattctgatttcagtgctcagtccattgtatttttttaagttttaaaaaaattccaagttatattttatttcctcattcataatacaataataagcatatattaatatttaatgtgtgtgttttttatgtgtatttcatgccctgggtctgttgtagatattggagatatagtgtaaattaacaaaatattttaagaatttcttcctaattgaaggtggcattctggtctatgaaatcatatactatagaacaagcatatatattgtcataattattaatacaatgaatgtaaaatgcttagtgaagtacataatgtaaatattaatctctaaataaatgtaacattgttatttttggaaaatgtgtatcactaatgccatatcaaagagctaaaaactcaaatacataaatcatcttctaaaacttgccaatgaatattttatacaatgtttataaattaatgttaatatttatgtataatgaaatgcaaagctcttaagtgtatattaagatgaattttgacacatgaatgcacagtacaagtaataaccaaatcagaatatagaacatttccatccccagagaatttcctcatgaccccttcctgtcaagctcttctctactcaagccctctatatttatatttctattcccataaataaatctagcttgttctgtaacttcatcacaatggcacaaatagtatgtatttgttttttttttttttttttttgatctggcttttgtttttttttggtctggcttttgtttttttttgagatagagtcttgatcattgttgattttattactgaatgtattattgcattgcattttatgaatatactataatttttaaatcaattattctattaatgaacacttggtagtttctagtctttgactcttacctataaagctttctaaatatccttgtacaagtagttttgtaaacatgtattttcactctttagtaaatacctagctgcattatggtgctttgtaggaaactaccagatacttttccaaaatggttgaaaatcttatacactaccagtatattaagagtttatgttgctgcacttcctccacaactttagttgtcatcagttgtttcaattttaggccttctagtagataaaaggccatagtcatagctcattgtagtttcaatatttgtttccttgatgactgatcaaataagcacctttttatgttcttacgggacatttgtgtagattttgctcatttttcaccaggtttgacttttttatgtattttgcatacaatttgtcagagagatggtgttacgggctgaactgtgtcccccaatatccatatgttgagacctaaaatccccaatgtgactgtatttagaaaggtgtataaggacgtaataaacgttaaatcaggtcatgaaagtcttaatctaataaaacttgtttcctcataaaaagaagacacaccagagatttctttctctttctgaacaggcacagaggagaggccatgtgaggacatggtgagaaggcagccgtctacaagccaggaagagaggcttaaccagaaaccaattgtggtggcactttgaagtttgacttctaacctccagaactacaagaaaataaatttctgttgtttgaaatacccaccctgtgatattttattatgaaagccctagtagactaatacagatttttagcaaatacttttcttttaggctgtggcttatgctttcaagggtgtgaagttatttcccctattttttcttctagaaactattattttaagcactctgcatgtatgcatgacccatgcgaaaatattttttatatgatgtgagattttgccattaaacgatcacagcaactttgttgaaagccacttagactgtgcatctactatagactactaagtgtagacttcctactctgatccattgttctacttgtttattattatgtcaataacaccatcttgattaatgaagctatattataagccttataatattttatttttatattttaaaattatatttacatatataaaacatttcatatttacataatataaaatatttacgttttatcatacttttatattaaatttaaaatttatattttatgtagttatatattaaatacataaatatataattcttattataagaaatcaggcaatgtatgtcctccaaatttatggttgcttttagtgttgttttgactattctaggtcctttgaatttccagaataattggttagtccatttgtaacaaattggttgttgggattttttattggggtttctttgaatctatagaataattggataacaaacattctaacaatatataatcttccaatccatgaaaactatttgtcttgccatagaccttctttaccatttctcccagaaatggttttaatgtttagtgcagatatattgcatgttgtccactaaattcattgctatgattttattgtttttatgccacagcaaatggtattgtgcttcaattaaaattttcacttgtttgttgctgttacatacaattgttcttttatatattgaccatgtatccagtgaatttgaaaaaaaagttattacatttataaaatatatttctcaggatttttcacgaatccaatcatttcatgtatgagtaaagagaggcttagtttcttttcagtcacgattttgctggatagcactggcaagacctctaatataatgttaaataaagcaatgagaactcacattcttgccttagttcaaatcttagtaagaaagcatcaatattctgccattacatatgatgttagttctaggtttttcagaaaaatacttcatcagatagaggaaattttcatttattctcattttactctgagctattaacatgactagatattaaagattgtttaatgatgtacccataatatttctcttttattagagtctcattttggattaattgctcttcaaaagttaaaccaatcctgcattcaatagataacgttccacatagtaatggattataatttatacttattattggacgcaatttgcaaatattttctttaaaatatttttatctttgtgtgtttcactgaatttctagatgtataggttgatatttttcaccagtttgacaagttttaagccattgttacttttaatatttttctctcttctcctagaaccacactcattgctatattacttgatattttcctatatattactagatcttcatttaattattttattattttggaagcttcactttagatcatgtctattgacctgtcattgatttcacttattcttttttctttactgtctaataagctgtttaacccattcagtgaattttctttcatttattgtacttttctagtatttccattttctttttatagatttcattcttttgcaatttcaaaattattctttcatatgtccaaatttttatttactttccttaaatatattttaacaactgtattaaatcctttttgttaactcaaaatcgatctcatctggtaatccatttttactgactgcttttgctgctaagtatatgtcacattttcctgtgtgtgtgtgtgtgtgtgtgtgtgtgtgtgtgtgtgtgtttttacatagctagtacattttttgaaattctgcacatggtcaatgttatcttaaaaggagagataatttctttctttatatggtactggtttgttctgataataaaaccctaacagatcttctgtattttgtttagctttagttatgatgtctttatttttgttaacttcttaattcaacggttatattctgattcaaaggtggtgtccttatccctataaaactttctgggttcttacgtaaatttccaagggtaggctagaactctaatggctccagtactgtatgacctcttatagtttccagtcggatctgagctgaacaggagctattgtctacaaggtaacaagcaaagtgctcagcatgaacatatgaagctcagttattaggtaagtactctcaaacatttccaggaagaattttggaatccttcttttgcagaattatgtatcttctctctctctgatcaaattctaggtgttttggtagctccaaactaatttttttctccatatcaatgtgcaccagacaatatgttaccagacaaaatgccagattgaatgtggagctcgtctgtatgtattttccttctttcaaggatatttcaagaaatatacatagccgggcgtggtggctcacgcttgtaatcccagcactttgggaggttgaggcgggcggatcacctgaggtcaggagtttgagaccagactgaccaacgtggtgaaaccccgtctctactaccaatacaaaattagctgggcgtggtggtgcaggcctgtaatcccagctactcaggaggctgaggcacgagaatcacttgaacccgggaggcagaggttgcagtgagcggagatcgcgccattgcactccagcctgggcaacgagagcgaaacttcgtctcaaaaaaaaaaaaaaagaaatatatatatatatatatgccttatagctaacttctagagtaaacaatgataaagaaattagaagcagaaagataaagataaatttacttcaaagagccaacagatggtagcaaacttcttcacaaaaatatattacaagaaacagagtcagataaagtgttcaggtaaccaaaaattgagaaattcttccacaaggagacctctcattctaaaaaactttgaagatgggatatttgatcacaagaaaaatttttcttgatgaaattgttgagatataagaaaaaaatggaaaagaacaacaaaaggttatagtatgtgagtgaatttaaataaatattgatgatataaaataattctcgttgtatattttggagttcaagagttcaagagaaagaataaaagcaaagtagaattaagataaaaataactgctgcaaagaagcttatagagataaatgatgttaaaatgttcaaagatcttagatcatgtaagaggaggaaaaacattgatagacatattataaaattaagcaaatatatttcaatgactagagtagcatcaaaaccattggaaacagcatacaactttcaaatagataggagtttcctgtggactattttggctgtaatttctgctattttctgttcaaagtatcttattttctatattctgagttactttaaccttaggctgatcattttccttatgattttatttgtataaacatttaagacccaggatgatggtgggtccctacaggaaagatgtgtaaatgtttctaccatttgctttggaattgcaagatatgtcaacatatgtaaagtgtcaacaaaataaataaatgccatatgtgaaaacttttaagtaaaaacattattgaaaacccaaaaacatacagatacacagtttttcaaagaaaacaatgataattcagagcacagactttttaaaaatagttgttacatttgtaaagtaagttatatgttaagaatcacatacaatataaaataattgaaaaaaattgcataatggcacagagaaaaatgttgatccttgtacatattatcagtacagtaactctattctacatgtatataaaaataaaaatgtaaaaatttggattctagatatttactggagcaaaaatattaatgctcagagcagaaagttagaaaactcagcagttttataactcatgaaacatttttaatgaaacagaaatgtaacattatgaaatcttgagatagtagaaatgaagtatgattaaactattttaaatttaaccaatattcatattcatatatgcattgaaaaattatacctttttctaagtttgattcttgaaaattatagttagttttaaattatttattttttcagtgattttgtcacatttaaaattcccccttgaaaaattgctttattaaagtgaaatatttgaatatggagtttgaagagtaacaaataatttttcttataatcagttgtaaaacatatataattttcaacattagtttagtatctacatgtattttaatcctataaaagcaatatttttattgtaaccagaaattagatattcataatgctaacagatttttaaatattatagctattagtatatataacttaaatatttctaatgtttgaaatttcctataaaactggttcttaaacccttcaactactagaagcctttaatgcagattgataaatgtgtactttacctaatttataataaatatggcatattaagtacattttctttcttgactctatatttccagaattttaattcagacttccataagaatcaggaaattatttactttgacctaaattaatttgaaactccctacaatggtactttgtgaacttcgtgtttttagttatttcagtttctgacatttgtgtatcaatatttttaaagttagtccattttcttacatgtgttctattcagcatgcttccaccaaaaaaaaaaaaaaattaagcaattatggctttcttccatttagattatgtgggcaggtctgtgggggtagtacagaaggtatatttcatctcaaacataaacaggaagccaatgtgctatggaatgaatgtttgacccctgtgaaactcatgttgaaacttaatccccaatgtggcagtattgagagatgggatctgaattaattaatgtaaattccagtagactcaacacactggcatcaaccattataattacaacaatttttatgaaacacttatattttcaatacctgttatcctttttgaaataataaggacagagaatgtaaaaggaagtggaaaagcacagtgtggttaagagattcataaaattgtgcttggattataaaacactttaaaataccttgagacatttttgaaccaaagtttgtcagaaatatctatacacatgtaattaatgacaactataagtaagctaagacaggctgggctgagaaggtggtattaggttttgggggcagaagtctttgcagaatgtaaagtataataggatagacggtatttcagtggaaacctactgattttttttgttttcctgtattcctttcacttttctgtctgtcactcttatttctttcaatcctctttgagcttttttgctcttttccttttatttctccactcttgctctctcaccctctctctcacacactcttcttcccacaattccttcgtccctctttctcctttaccacatccctttcagaaacctttattgaagatatattatgtgaaaggtatgaggtattcaca

SEQ ID NO: 38 - DNA, 11415 bp, Homo sapiens
ggccagtctttcttattggattatagtgattttattaggctatcagtaagtaaacaaggtattttttaaaggagacattgaatcactctataaaatatgaaataaactctttcttgattaaagtctttggatacaagctttcaattctttgcataataattattgtaaaatatgataacacatgcttgaaaatgaaaagactaaaatataaagatttatttgttctatcccctgaaaagacagcactgattctatcacacacagatataggtatttatcttcctatagatcatacctaatattctcagagttgataatatattagagaattataatgcatatcatatatgtatctctcaggttacagaaatttcaaatggtgtagtaaaattaattttttgaggtccaggagattatcagattaactgaatcataaggtgactcacaaaatatatgagagtaaacaattatatatagtagaaaaatatatctgaatctgcattcatttttgaactatgtatttactctacctagatgcaaatcttttccccagtctgcctgtttcccatattattcccatattatatgtaaatatttctatatagacatgtatatagaaatatataaacatacatatgtatcagtctgcatatttatgtatgtgtgttagtctgcctgaagctgctataacaaaacatcacagactgtgtagcttaaacaacagaaatttagtttctcacagctctggagtttggaagtccaagattaaggtgccagcaaggttggtttctggtgaggcctctctctctctccttggtttgtagaaagcaccttattgctgtatcctcacatgatcattctctgtaagagagagctcttgtctctttaccaactaaaaaggacaccagccctgtttgcctaacaaggcaaatttccttagatattaaggctcacgcataatcctctttggtctgatgcgctgccttttgggtccactggggtaatagcgtcacctcccctactctgcacagaagccccatccctgtggcctgggcagccctgcccctgaggtactgggcagtggcattctgccctgctgaaacccaggaggtggccctcttcctctgagaccaaagagaaaacacctttgccttgttgggtatgtgatgggagtagcaactgtgctgctctctgaatcactttcagggctgttcttcctatttcttgaaggataatgcatgtttgaagccagttaattctattgtcttgttctgcagagtcccagaagtctgacagccttcctttattacatccaattctctctgttttgtttattccagctgtcagtgcttctgctgatgtaattccatctccgttcctgtcctcagcagagatggctgattaaatccataggtaatctctttaaggagcaaatttccagccacacactttgtctctctagaacatgctttccactttttgcaacatagttagtctgataattttccaaaacttcaaatttccagccacacactttgtctctctagaacatgctttccactttttgcaacatagttagtctgataattttccaaaacttcaaatcctggttccatcttgcttaaaaatttcttcaatttgtatatcttctctcacattttactctaagcaataaggaaaaatccagcctcaccttcaacactgtgcttctacatctcttctgccaaatatccaaggacatcactcatattttaccttccacaagagactagaacacaattcagtgaaattctttgccactttatggcaagactgcctttcctccaatttccaataacatatttctcaccttgagacctcaccagaagcacctttgttcatgtatctaccaatattctgtttaggataatataagtattctctaagatgagacattttctctaaagatcttcttatttatctgtatatatgtatgtgtgtatacatatatacatatacacatatacatatatgtatacatttatacacataaacacacacaaaaattctaaccttcagtctgacatattagatgggatctttgggaggcaattaggtcacagggtggagccctcatgattgaacttagcacccttataaaaggaactcatagttctcttgccctctttctgccatgtgaaggtacaagaaaatggcagtccgcagagagcactcatcaaaacctgaccatgttggcacagttatcccagacttccaggctccagaactgtgagaaaataaatttctgttttttataagccaccttactctatgaaacgttgttatagcagctcaaactaagatagacagacagatagatacgtagatatatagagagatgatagcacatttttaactggaaacatcatcatctttttaactcaaaaaagtaaaagatgcattcttagtagaattattcttacacaggcaagacatctgcctctatcaattcaaatgtatagtctaacttcagcaagaatatctctgtaggggtaattgtaatatctggtaaatagtaagcataatttatagcttaagagagatttacactaatttatacttgaccagaaattaaaaaaatatgtcaatgaaaatattgttacaataaacaactcaggaaatgggaattgtaaagctcagagcatggctccctaagtttcatttaagtaagatcagaatttttggaatacttcattttaaatcatgcatattcagaacactggctaatggaataaagtttagtaatatatttaaatatgcagtctcaaaaatgttgtcactatgaaacatacaaaaacaaccaggagtatttaacttgaatacacagtctaagtagatgtacatatacataacccattacaaagtcctaaaaccgaaatcacttcattttatcagtagagtctgaaggccattcagtcatttgtttttcccctgggatattagcactattgcaaaacccaaaaagaatattttttccacaatctaatttttttgactaatctgtttgactttctgacattacatttgcattttttagtaacctctacagttataaaacattgctttttagatgaattcataataaaaattattttaataaaccttatgatatgtttttctcgcattttcattgttcgcatgcatagaaattgcttcctattccatcagatcttctcattttactggggtatttttaagtcagtttgagtagttgttcataaacttttatttttataaattgtgacactcttgtgggtaaaatttacactttaactaggaatgatggttcactatagaatgatgcttttctgacagttgttgatttgagagcatgtctctgttaactttaattccatctctttttttccctgtaatgctcaaaatgccaatacatcttcatttaccggttgaaaattcctcttcccaaggcaccaagggtctactaaagagtatgtcactaaaactgttgcatttttgcaagcttgggcatcacatatggctcacgctagactcagatagctgtgtggagcaaatgctcaaatctgtgccagaatttgttcattttaacatcactgggactttcaaagaacaaatgccatctatgtgaaaataacacactattaaaggatttaatagcgttactcataatggttaccttaatgataatgctgaattgatctattctgaaatttattccagattaaaacatcttgatagactgttgctgctactgctactgctgctgctgctgctgcatccctagatttttcttcatatggctataacttttgatatgccaataggaaccatatcagtgacagaagaataaggatgctcgtggaatcctcagggatagaagcagcagtgtgtagcagctggagtatgaaggcttatggcagaggcagcagtgagtggaggcagagacaaaaaggaaggatccagggtaatgcaggattagcaggagagatgacaatgttaagggacagtttaggggaaaaagtagaattttgttctaaataagctgcatattctgatttcagtgctcagtccattgtatttttttaagttttaaaaaaattccaagttatattttatttcctcattcataatacaataataagcatatattaatatttaatgtgtgtgttttttatgtgtatttcatgccctgggtctgttgtagatattggagatatagtgtaaattaacaaaatattttaagaatttcttcctaattgaaggtggcattctggtctatgaaatcatatactatagaacaagcatatatattgtcataattattaatacaatgaatgtaaaatgcttagtgaagtacataatgtaaatattaatctctaaataaatgtaacattgttatttttggaaaatgtgtatcactaatgccatatcaaagagctaaaaactcaaatacataaatcatcttctaaaacttgccaatgaatattttatacaatgtttataaattaatgttaatatttatgtataatgaaatgcaaagctcttaagtgtatattaagatgaattttgacacatgaatgcacagtacaagtaataaccaaatcagaatatagaacatttccatccccagagaatttcctcatgaccccttcctgtcaagctcttctctactcaagccctctatatttatatttctattcccataaataaatctagcttgttctgtaacttcatcacaatggcacaaatagtatgtatttgttttttttttttttttttttgatctggcttttgtttttttttggtctggcttttgtttttttttgagatagagtcttgatcattgttgattttattactgaatgtattattgcattgcattttatgaatatactataatttttaaatcaattattctattaatgaacacttggtagtttctagtctttgactcttacctataaagctttctaaatatccttgtacaagtagttttgtaaacatgtattttcactctttagtaaatacctagctgcattatggtgctttgtaggaaactaccagatacttttccaaaatggttgaaaatcttatacactaccagtatattaagagtttatgttgctgcacttcctccacaactttagttgtcatcagttgtttcaattttaggccttctagtagataaaaggccatagtcatagctcattgtagtttcaatatttgtttccttgatgactgatcaaataagcacctttttatgttcttacgggacatttgtgtagattttgctcatttttcaccaggtttgacttttttatgtattttgcatacaatttgtcagagagatggtgttacgggctgaactgtgtcccccaatatccatatgttgagacctaaaatccccaatgtgactgtatttagaaaggtgtataaggacgtaataaacgttaaatcaggtcatgaaagtcttaatctaataaaacttgtttcctcataaaaagaagacacaccagagatttctttctctttctgaacaggcacagaggagaggccatgtgaggacatggtgagaaggcagccgtctacaagccaggaagagaggcttaaccagaaaccaattgtggtggcactttgaagtttgacttctaacctccagaactacaagaaaataaatttctgttgtttgaaatacccaccctgtgatattttattatgaaagccctagtagactaatacagatttttagcaaatacttttcttttaggctgtggcttatgctttcaagggtgtgaagttatttcccctattttttcttctagaaactattattttaagcactctgcatgtatgcatgacccatgcgaaaatattttttatatgatgtgagattttgccattaaacgatcacagcaactttgttgaaagccacttagactgtgcatctactatagactactaagtgtagacttcctactctgatccattgttctacttgtttattattatgtcaataacaccatcttgattaatgaagctatattataagccttataatattttatttttatattttaaaattatatttacatatataaaacatttcatatttacataatataaaatatttacgttttatcatacttttatattaaatttaaaatttatattttatgtagttatatattaaatacataaatatataattcttattataagaaatcaggcaatgtatgtcctccaaatttatggttgcttttagtgttgttttgactattctaggtcctttgaatttccagaataattggttagtccatttgtaacaaattggttgttgggattttttattggggtttctttgaatctatagaataattggataacaaacattctaacaatatataatcttccaatccatgaaaactatttgtcttgccatagaccttctttaccatttctcccagaaatggttttaatgtttagtgcagatatattgcatgttgtccactaaattcattgctatgattttattgtttttatgccacagcaaatggtattgtgcttcaattaaaattttcacttgtttgttgctgttacatacaattgttcttttatatattgaccatgtatccagtgaatttgaaaaaaaagttattacatttataaaatatatttctcaggatttttcacgaatccaatcatttcatgtatgagtaaagagaggcttagtttcttttcagtcacgattttgctggatagcactggcaagacctctaatataatgttaaataaagcaatgagaactcacattcttgccttagttcaaatcttagtaagaaagcatcaatattctgccattacatatgatgttagttctaggtttttcagaaaaatacttcatcagatagaggaaattttcatttattctcattttactctgagctattaacatgactagatattaaagattgtttaatgatgtacccataatatttctcttttattagagtctcattttggattaattgctcttcaaaagttaaaccaatcctgcattcaatagataacgttccacatagtaatggattataatttatacttattattggacgcaatttgcaaatattttctttaaaatatttttatctttgtgtgtttcactgaatttctagatgtataggttgatatttttcaccagtttgacaagttttaagccattgttacttttaatatttttctctcttctcctagaaccacactcattgctatattacttgatattttcctatatattactagatcttcatttaattattttattattttggaagcttcactttagatcatgtctattgacctgtcattgatttcacttattcttttttctttactgtctaataagctgtttaacccattcagtgaattttctttcatttattgtacttttctagtatttccattttctttttatagatttcattcttttgcaatttcaaaattattctttcatatgtccaaatttttatttactttccttaaatatattttaacaactgtattaaatcctttttgttaactcaaaatcgatctcatctggtaatccatttttactgactgcttttgctgctaagtatatgtcacattttcctgtgtgtgtgtgtgtgtgtgtgtgtgtgtgtgtgtgtgtgtttttacatagctagtacattttttgaaattctgcacatggtcaatgttatcttaaaaggagagataatttctttctttatatggtactggtttgttctgataataaaaccctaacagatcttctgtattttgtttagctttagttatgatgtctttatttttgttaacttcttaattcaacggttatattctgattcaaaggtggtgtccttatccctataaaactttctgggttcttacgtaaatttccaagggtaggctagaactctaatggctccagtactgtatgacctcttatagtttccagtcggatctgagctgaacaggagctattgtctacaaggtaacaagcaaagtgctcagcatgaacatatgaagctcagttattaggtaagtactctcaaacatttccaggaagaattttggaatccttcttttgcagaattatgtatcttctctctctctgatcaaattctaggtgttttggtagctccaaactaatttttttctccatatcaatgtgcaccagacaatatgttaccagacaaaatgccagattgaatgtggagctcgtctgtatgtattttccttctttcaaggatatttcaagaaatatacatagccgggcgtggtggctcacgcttgtaatcccagcactttgggaggttgaggcgggcggatcacctgaggtcaggagtttgagaccagactgaccaacgtggtgaaaccccgtctctactaccaatacaaaattagctgggcgtggtggtgcaggcctgtaatcccagctactcaggaggctgaggcacgagaatcacttgaacccgggaggcagaggttgcagtgagcggagatcgcgccattgcactccagcctgggcaacgagagcgaaacttcgtctcaaaaaaaaaaaaaaagaaatatatatatatatatatgccttatagctaacttctagagtaaacaatgataaagaaattagaagcagaaagataaagataaatttacttcaaagagccaacagatggtagcaaacttcttcacaaaaatatattacaagaaacagagtcagataaagtgttcaggtaaccaaaaattgagaaattcttccacaaggagacctctcattctaaaaaactttgaagatgggatatttgatcacaagaaaaatttttcttgatgaaattgttgagatataagaaaaaaatggaaaagaacaacaaaaggttatagtatgtgagtgaatttaaataaatattgatgatataaaataattctcgttgtatattttggagttcaagagttcaagagaaagaataaaagcaaagtagaattaagataaaaataactgctgcaaagaagcttatagagataaatgatgttaaaatgttcaaagatcttagatcatgtaagaggaggaaaaacattgatagacatattataaaattaagcaaatatatttcaatgactagagtagcatcaaaaccattggaaacagcatacaactttcaaatagataggagtttcctgtggactattttggctgtaatttctgctattttctgttcaaagtatcttattttctatattctgagttactttaaccttaggctgatcattttccttatgattttatttgtataaacatttaagacccaggatgatggtgggtccctacaggaaagatgtgtaaatgtttctaccatttgctttggaattgcaagatatgtcaacatatgtaaagtgtcaacaaaataaataaatgccatatgtgaaaacttttaagtaaaaacattattgaaaacccaaaaacatacagatacacagtttttcaaagaaaacaatgataattcagagcacagactttttaaaaatagttgttacatttgtaaagtaagttatatgttaagaatcacatacaatataaaataattgaaaaaaattgcataatggcacagagaaaaatgttgatccttgtacatattatcagtacagtaactctattctacatgtatataaaaataaaaatgtaaaaatttggattctagatatttactggagcaaaaatattaatgctcagagcagaaagttagaaaactcagcagttttataactcatgaaacatttttaatgaaacagaaatgtaacattatgaaatcttgagatagtagaaatgaagtatgattaaactattttaaatttaaccaatattcatattcatatatgcattgaaaaattatacctttttctaagtttgattcttgaaaattatagttagttttaaattatttattttttcagtgattttgtcacatttaaaattcccccttgaaaaattgctttattaaagtgaaatatttgaatatggagtttgaagagtaacaaataatttttcttataatcagttgtaaaacatatataattttcaacattagtttagtatctacatgtattttaatcctataaaagcaatatttttattgtaaccagaaattagatattcataatgctaacagatttttaaatattatagctattagtatatataacttaaatatttctaatgtttgaaatttcctataaaactggttcttaaacccttcaactactagaagcctttaatgcagattgataaatgtgtactttacctaatttataataaatatggcatattaagtacattttctttcttgactctatatttccagaattttaattcagacttccataagaatcaggaaattatttactttgacctaaattaatttgaaactccctacaatggtactttgtgaacttcgtgtttttagttatttcagtttctgacatttgtgtatcaatatttttaaagttagtccattttcttacatgtgttctattcagcatgcttccaccaaaaaaaaaaaaaaattaagcaattatggctttcttccatttagattatgtgggcaggtctgtgggggtagtacagaaggtatatttcatctcaaacataaacaggaagccaatgtgctatggaatgaatgtttgacccctgtgaaactcatgttgaaacttaatccccaatgtggcagtattgagagatgggatctgaattaattaatgtaaattccagtagactcaacacactggcatcaaccattataattacaacaatttttatgaaacacttatattttcaatacctgttatcctttttgaaataataaggacagagaatgtaaaaggaagtggaaaagcacagtgtggttaagagattcataaaattgtgcttggattataaaacactttaaaataccttgagacatttttgaaccaaagtttgtcagaaatatctatacacatgtaattaatgacaactataagtaagctaagacaggctgggctgagaaggtggtattaggttttgggggcagaagtctttgcagaatgtaaagtataataggatagacggtatttcagtggaaacctactgattttttttgttttcctgtattcctttcacttttctgtctgtcactcttatttctttcaatcctctttgagcttttttgctcttttccttttatttctccactcttgctctctcaccctctctctcacacactcttcttcccacaattccttcgtccctctttctcctttaccacatccctttcagaaacctttattgaagatatattatgtgaaaggtatgaggtattcaca

SEQ ID NO: 39 - DNA, 1397 bp, Homo sapiens
tgctgagaatgtgtattcttgcaacatctctgaaaatgttgcgatttttttctctctctttttttaagtactactttattgagttacatgggacatacaataaaatatcctattataactatacaattgaaacattttggtaattttgtatagccatgtaatcaccataacaatcaagatgtaaaacctttcattcaccttaaaaagttcatttgtgcccctttatggtcattcacatccccttttctgagtatagttttacaatatattctttcagaaagcttgcaattttccattcttgaatatgtctttgaaagatcaaaagttgtaattttgatgaagtgaagtttatccaactttttatttattgttactgtttatatcacattattaaaaaaaaccttgcctagccctctaaaattgttcaaattttatttgataaaagtatttgataaaattcaaatacttagtatagaaaaaataaacttttagattttgtttcaattttattttttagccccatgtctttctctctctgacatatagacaactcctatttttatcaaactaaacatattatacaaacaataaatcaaaataataaaatagtgataattttaaaacttagactattaaagaaatatattttatttagttatgtgatttcatgatagaaagcattgtataaatgatgcaagaaaccccacaaaccatagcaatcatttaaaaaaaaaacgtgctttaaaatcttctacaggaagaaattaaaaacaaatgtagagatagggaaaaatattttaacataaaattttagtttcagaaaatacaaagcattctgacatttgacttacaaaaagacaactcaaatagagaaatagaggaaataataaaaataggcaactagttcatcaaagaaaaagggattgaattataagtaaaacataaagtgttcttagctttctgataactagggaaatttaaacagaaatagtaataagatatgtttgaataaccatcagatgataatcgacaatgagaaagaatgaagttgggaatataatgtatttctaataaaaccgaaaataaacacatctaaaaatctagtgattctacttctaagaatatgcagaatatgcacatcttatgatctagcaattccacttctaagaatatacactaaagttactcttaaccactgctcactctaaacattagaaatacccaaatatctttataaactatttatttgcatatcaataggtatagaacgcagaaatattctcttgagaggataaataggcagcagaccacacacaacatttaaacagtatatagtaaaattatggaaattacttttgaaggcccccgtcatctgcatacgaatgcttattcgagga

SEQ ID NO: 40 - DNA, 6310 bp, Homo sapiens
tgagacacattactaaataaatggtaatagaattattccctaaaacattggaaattgttctgttccaaggtggcagaataggaatagctctagtctgcagctcccagtgtgattgacacagaagacaggtgatttctgcatttccaactgaggtacctggttcaactcattaggactggttggacagtgggtgcaacccacagagggtgagccaaagcagggtgggtcatcacctcacctgggaagtgcaaggggttgggggatttccctttcctagccaagggaagccgtgacaggctgtaccaggaatatcgggacactgccacctaaatactgcacttttccaatggtcttagcaaatgggacagcaggagattatatcccatgcatggctcagctggtcccatgcccacagagccttgctcacttgctagctcagcagtccaagatcgaactgccaagcagcaagcctggctggggaggggcatccaccattgctgaggcttgagtaggcaaacaaggtgaccaggaatcttgaactcggtggagcccaccacagctcagcgaggctcacctgcctctgtagactccacctctgggggcagggcatagctgaacaaaggcagtagaaacttctgcagacttaaacatccctctctgacagctctgaagagagcagtggttcttgcagcatggtgtttgagctctgagaatggatagactgcctcctcaagtgggaccctgaccccgtgtagcctaacttggagacacctccaagtaagggctgactgacacttcatacagctggtgcccctctgagatgaagcatccagaggaaggatcaggcagcaatatttgctgttctgcaatatttgctgttctgcagcctctgctggtgatacccaggcaaacagcatctggagtggagctccagcaaactccaacagacttgcagctgagggacctgactgttaggaggaaaactatcaaacagaaaggaataccactaacatcaacaaaaaggacattcacaccaaaaccccatctgtaggtcatgatcatcaaagaccaaaggtagataaaaccacacagatggggagaaacaagagcagaaaagctgaaaattctaaaaaccagagtgcgccttctcctccaaaggattgcagctccttgccagcaatggaacaaagctggatggagaatgactttgaggagttgacagaagtaggcttcagaaagtcagtaataacaaacttccctgagctaaaggaggatgttcaaacccatcacaaggaagctaaaaaccttgaaaaaagattagatgtatggcaaactagaataaacagtgtagagaagacgttaaatgacatgatggagctgaaaaccatggcaggagaactatgtgacacatgcacaagcttcagtagctgattcgatcaagtggaagaaagggtatcagtgattgaagatcaaatgaatgaaatgaagctagaagagaagtttagaggaaaaaagagtaaaaagaaacaaacaaagcctccaagaaatatgggactatgtgaaaagaccgaatctacatttgattggtgtacctgaaagtgacggggagaatggaactaagctggaaaacactcttcagtatattatccgggagaacttccccaacctagcaagtcaggccacattcaaattcaggaaatacagagaacaccacaaagatactcctcgagaagagcaaccccaagacacataattgtcagattaaccaaggttgaaatgaaggaaaaaatgttaagggtagtcagagagaaaggtcgggttacacacaaagggaagcccatcagactaatagcagatctgtcggcagaaactctacaggtcagaagagagtgagagccaatattcaacattcctaaagaaaataattttcaacccagaatttcatatacacccaaactaagcttcataagtgaaggagaaataaaatcctttacagacaagcaaatgctgagaggttttgtcaccaccaggcccgccttacaagagctactgaaggaagcactaaacacggaaaggaaaaaccagtgcaagccactgcaaaaacatgccaaattgtaaacaccattgacgctaggaagaaactgcatcaactaaagggcaaaataaccagctaacatcataatgacaggaacaaattcacacataacatattaaccttaaatgtaaatggactaaattccccaattaaaagacacagactggcaaactggataaagagtgaagacccatcagcgctattagtgcgctgtattcaggagacccatttcatatgcagagacacacataggctcaaaataaagggatggaggaagatctaccaagcaaatggaaagaaaaaaaaaccaggggttgcaatcctagtctctgattaaacagacattaaaaaaacaaaggtcaaaagagacaaagaagggcattacataatggtaaaggatcaattcaacaagaagagctaactgtcttaaatatacatgtgcccaatacaggagcacccagattcataaagcagtccttagagacctgcaaagagacttagactcccacaaaatagtatagggagaatttaacaccccactgtaaatatcagacagatcaatgagacagaaggttaacaaggatatccaggacttgaactcaggtctgcaacaagcagacctaatagacatctacagaactgtccaccccaaatcaagagagtatacattcttctcagcaccacattgcacttattccaaaattgaccacatagttggaagtaaagctctcctcagaaaatgaaaaagaacagaaatcacaacaaactgtctctcagaccacagtgcaatcaacttacaactcaggattaaggaactcactcaaaaccgcccaactacatggaaactgaacaacctgctcctgaaggactactgggtacataacgaaatgaaggcagaaataaagatgttctttgaaaccaatgagaacaaagacacaacataccagaatccctgggacacatttaaagcagtgtgtagagggaaatttacaacactaaatgcccacaagagaaagcaagaaagatctaaaatcgacaccctaacatcacaattaaaagaactagagaagcaagagcaaacacattcaaaagctagcagaaggcaagaaataattaagatcagagcagaactgaagcagacagaggcacaaaaaaccattcaaaaatcaatgaatccaggagccggttttttgaaaagatcaacaaaattgatagaccactagcaaaactaataaagaagaaaagagagaagaatcaaatagatacaataaaaaatgataaaagggatatcaccaccaatcccacagaaatacaaacttccatcagagaatactataaacacctctacgcaaatagactagaaaatctagaagaaatggataaattcctcgacacatacaccctcccaagactaaaccaggaagaagttgaccccctgaataggccaataacaggctctgaaattgaggcaataattagtagcctaccaaccaaaaaaagtccaggaccagacagattcacagccggattctaccagaggtaaaaagaggagctggtaccattccttctgaaactatcccaatcaacagaaaaagagggaatcctccctaactcatttgatgaggccagtatcactgtgataccaaagcctggcagagacacacaaaaaaagagaattttagaccaatattcctgatgaacatcgatgcaaaaatcctcaataaaatactcgcaaactgaatccagcagcatatcaaaaagcttatccaccaagatcaagttggtttcatccctgggatgcaaggctggttcaacatatgcaaatcaataaaagtaaaccatcacataaacagaaccaatgataaaaactacatgattatctcaatagatgcagaggaggcctttgacaaaattcaacaacacttcatgctaaaaactctcaataaactaggtattgatggattgtatctcaaaataataagaactgcttatgacaagcccacagccagtatcatactgaatgggcaaaaaaatggaagcattccctttgaaaactggcacaagacagggatgccgtctttcaccattcctattcaacatagtgttggaagttcaggccggggcaatcaggcaagagaaagaaataaagcgtattcaattaggaaaagaggaagtcaaattgtccctgtttgcagaagacatgatggtatatttagaaaaccccatcgtctcagcccaaaatctccttaagctgataagcaactttagcaaagtctcaggatacaaaatcaatgtgcaaaaatcacaagcattcttatacaccaacaacagacaaacagagagccaaatcatgaatgaactcccattcacaattgctacaaagagaataaaatacctaggaatccaacttacaaaggatgtgaaggacctcttcaaggagaactacaaaccactgctcaatgaaataaaggaggacacaaacaaatggaaaaacattccatgctcatggataggaagaatcaaaatcgtgaatatggccatactgtccaaggtaatttctaggttcaatgccatccccatgaagctaccaatggctttcttcacagaattagaaaaaactactttgaagttcatatggaaccaaaaaagagcccgcattgccaagtcaatcctaagccaaaagagcaaagctggaggcatcatgctacctgacttcaaactatactacaaggctacagtaaccaaaacagaatggtactggtaccaaaacagacatatagaccaatggaacagaacagagccctcagaaataacaccacacttctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaactataaaaaccctagaagaaaacttaggcaataccattcaggacataggcatgggcaaggacttcatgtctaaaacaccaaaagcaatggcaacaaaagctaaaattgacaaatgggatctaattaaactaaagagcttctgcacagcaacagaatcgaccatcagagtgaacaggcaacctacagaatgggagaaaatttttgcaatctacccatctgacaaagggctagtgtccagaatctacaaagaacttaaacaaatttataagaaaaaatcaaacaaccccatcaaaaagtgggcaaaggatatgaacagatacttctcaaaagaagacatttatgcagccagcagacacatgaaaaaatgctcatcatcactggtcatcagagaaatggaaatcaaaatcacaatgagatagcatctcataccagttagaatggggatcattaaaaagtcaggaaacaacaggtgctggataggatgtagagaaataggaatgcttttacactgttggggggactgtaaactagttcaaccattgtggaagacagtgtggcgattcctcaaggatcgagaactagaaataccatttgaaccagccatcccattactgggtatatacccaaagtattataaatcatgctactataaagagtcatgcacacatatatttgttgtggcactattcacaatagcaaagacttggaaccagcccaaatgtccatcaatgatagactggattaagaaaatgggcacatatatacactatggaatactatgcagccataaaaaaggatgagttcatgccctttgtagggacatggatgaagctggaaaccatcattctgagcaaactatcgcaaggacagaaaaccaaacactgcagtttctcgctcataggtgggaactgaacaatgagaacagttggacacagggtgtggaacatcacacactggggcctgttgtggggtggggggatgggggagggataacattaggagaaatacctaatgtaaatgatgagttaatgggtgcagcaaaccaacatggcacatgtatacatgtgtaacaaacctgcatgttgtgcaaatgtacactagaatttaaagtataataaaaaaattggaaatttgtgtgggagaaataactattgggatttaatgtcaaaggtacaatatttacacataaaaagttttattatgggta

SEQ ID NO: 41 - DNA, 6312 bp, Homo sapiens
aactgcagaattcctgacacataatagttgttctataattggtagttaaaattacacttatagatcatttcacctaggatttagctaagctctctatacctagaatacagttaagaatgacattattagagggcagccaagacggccgaataggaacagctcctgtctacagctcccagcatgagcaacgcagaagacgggtgatttctgcatttccatctgaggtaccgggttcatatcactagggagtgccagacagttggtgcggggcagtgggtgggtgcaccgtgcatgagccgaagcagggtgaggcattgcctcactccagaagcgcaaggggtcagggagttccctttcctagtcaaagaaaggggtgacagatggcacctggaaaatcaggtcattcccacccgaatactgtgcttttctgagaggcttaaaaaacggtgcaccaggagattatatcccgcacctggcttggagggtcctatgcccacggagtctcgctgattgctagcacagcagtctgagatcaaactgcaaggcggcagcgaggctgggggaggggtgcccgccattgcccaggcttgattaggtaaacaaagcagctgggaagctcgaactgggtggagcccaccacagctcaaggaggcctgccggcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccctgagcagcctaactgggaggcaccccccagtaggggcagactgacacctcacacggccgggtactcctctgagacaaaacttccagaggaacaatcagacagcagcattcgcagttcaggaaaatccgctgttctgcagccaccactgctgatacccaggcaaacagggtctggagtggacctctagcaaactccaacagacatgcagctgacggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctactccaaaggaacgcagttcctcaccagcaatggaacaaagctggacggagaatgactttgacaagttgagagaagaaggcttcagatgatcaaactactctgagctacaggaagaaattcaaaccaaaggcaaagaagttaaaaactttaaaaaaaaattagacgaatgtataactagaataaccaatacagagaagtgcttaaaggagctgatggagctgaaagccaaggctcgagaactacgtgaagaatgcagaagcctcaggagctaatgcaatcaactggaagaaagggtaccagtgatgtaagatcaaatgaatgaaatgaagcaagaagggaagtgtagagaaaaaagaataaaaagaaatgaacaaagcctccaagaaatatgggactatgtgaaaagaccaaatctacgtctgatttgtgtacctgaaagtgacgggtagaatggaaccaagttggaaaacactctgcaggatattatccaggagaaattccccaatccagcaaggcaggccaacattcagaatcaggaaatatagagaacgccacaaagataccccttgagaagagcaactccaagacacataattgtcagattcaccaaagttgaaatgaaggaaaaaatgtaaagggcagccagagagaaaggtcgggttacccacaaagagaagcccatcagactaacagcggatctctcggcagaaactctacaagccagaagagagtgggggccaatattcaacattcttaaagaaaagaatattcaacccagaatttcatatccagccaaactaagcttcataagtgaaggagaaataaaatactttacagacaagcaaatgctgagagatttttgtcaccaccaggcctgccctaaaagagctcctgaaggaagcaataaacatggaaaggaacaactggtaccagctgctgcaaaatcatgccaaaatgtaaagaccatcaagactaggaagaaactgcatcaactaatgagtaaaataaccagctaacatcataatgacaggatcaaattcacacataacaatattaaccttaaatgtaaatggactaaatgctccaattaaaagacacagactggcaaattggataaagagtcaaaacccatcagtgtgctgtattcaggaaacccatctcacgtgcagagacacacataggctcaaaataaaaggatggaggaagatcaaccaagcaaatggaaaacaaaaaaaggcaggggttgcaatcctagtctctgataaaacagactttaaaccaacaaagatcaaaagagacaaagaaggccattacataatggtaaagggatcaattcaataagaagagctaactatcctaaatatatatgcacccaatacaggagcacccagattcataaagcaagtcctgagtgacttacaaagagacttagactcccatacattaataatgggagactttaacaccccactgtcaacattagaaagatcaacgagacagaaagttaacaaggatacccgggaattgaactcagctctgcaccaagcagacctaatagacatctacagaactctccaccccaaataaacagaatatacatttttttcagcaccacaccacacctattccacaattgaccacatagttggaagtaaagctctcctcagcaaatgtaaaagaacagaaattataacaaactatctctcagaccacagtgcaatcaaactagaactcaagattaagaaactcactcaaaaccgctcaactacatggaaactgaacaacctgctcctgaatgactactgggtacataacaaaatgaaggcagaaataaagatgttctttgaaaccaacgagaacaaagacacaacataccagaatccctgggacacattcaaagcagtgtgtagagggaaatttatagcactaaatgcccacaagagaaagcaggaaagatagaaaattgacaccctaacatcacaattaaaagaactagaaaagcaagagcaaacacattcaaaaggtagcagaaggcaagaaataactaaaatcagagcagaagtgaaggaaataaagacacaaaaaacccttcaaaaaattaatgaatccagaagctggttttttgaaaagatcaacaaaattgatggactgctagcaagattaataaagaaaaaaagaagaatcaaatagacacaataaaaaatgataaaggggttatcaccactgatcccacagaaatacaaactaccatcagagaatactacaaacacctctacacaaataaactagaaaatctagaagaaatggataaattcctcgacacataaaccctcccaagactaaaccaggaagaagttgaatctctgaatagaccaaaacaggctctgaaattgtggcaataatcaatagcttaccaaccaaaaagagtccaggaccagatggattcacagctgaattctaccagagaggtacaaggaggaactggcaccattccttctgaaactattccaatcaatagaaaaagagggaatcctccctaactcattttatgaggccagcatcatcctgataccaaagctgggcagagacacaaccaaaaaagagaatttgagaccaatatccttgatgaacactgatgcaaaaatcctctataaaatactggcaaaccgaatccagcagcacatcaaaaagcttatctaccatgatcaagtgggcttcatccctgggatgcaaggctggttcaatatatgaaaatcaataaatgtaatccagcatataaacagaaccaaagacaaaaaccacatgattatctcaatagatgcagaaaaggcctttgacaaaattcaacaacccttcatgctaaaaactctcagtaaattaagtattgatgggacgtatctcaaaataataagagctatctatgacaaacccacagccaatatcatattgaatgggcaaaaactggaagcattccctttgaaaactggcacaagacagggatgccctctctcaccactcctattcaacatagtgttggaagttctggctagggcaattaggcaggagaaggaaataaagagtattcaattaggaaaagaggaagtcaaattatccctgtttgcagatgacatgattgtatatctagaaaaccccattgtctcagcccaaaatctccttaagctgataagcaacttcagcaaagtctcaggatacaaaatcaatgtacaaaaatcacaagaattcttatacaccaatagcagacaaacagagagctaaatcatgagtgaattcccattcacaattgcttcacagagaataaaatacttaggaatccaacttacgagggatgtgaaggacctcttcaaggagaacaacaaaccactgctcaatgaaataaaagaggatacaaacaaatggaagaacattccatgctcatgggtaggaagaatcaatatcgtgaaaatggccatactacccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaatagagccctcagaaataacgccgcatatctacaactatctgatctttgacaaacctgagaaaaacgagcaatggggaaaggattccctatttaatcaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccatgcaggacataggcatgggcaaggacttcatgtctaaaacaccaaaagcaatggcaacaaaagacaaaattgacaaatgggatctaattaaacgaaagagcttctgcacagcaaaagaaactaccatcagagtgaacaggcaacctacaaaatgggagaacatttctgcaacctacctatctgacaaagggctaatatccagaatctacaaagaactcaaacaaatttacaagagaaaaacaaaaaaccccataaaaaattggccaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtctggaaacaggtgctggagaggatgtggagacataggaacacttttacactgttggtgggattgtaaactagttcaaccattgtggaagtcagtgtggcgattcctcagggatctagaactagaaataccatttgacccagccatcccgttattgggtatatacccaaaggattataaatcatgctgctataaagacatatgcacacgtatgtttattgcagcactattcacaatagcaaagacttggaaccaacccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgagaactgaacagtgagaacacatggacacaggaaggggaacatcacactctggggactgttgtggtgtggagtgggggagggatagcattaggagatatacctaatgctaaatgacaagttaatgggtgcagcacaccagcatggcacacgtatacatatgtaactaacctgcatattgtgcacatgtaccctaaaactgaaagtataataataataaaataaaaaaagaatgacattattagctttattccattaa

SEQ ID NO: 42 - DNA, 7946 bp, Homo sapiens
attcttaattgagagcagtcatatcacaaatacacaaacatcttttcaggtgaaccctccactggtattgacaatggagaaagctctgagaaattcacctttagatttgagttaatttgagttgtggtaaatcttagtaacaacaacaaacagtagcactaaaatgtatgtagatgcattaggctaagtattttatgtgtatcactctatttaatctttacaacaacccatgagcaatactattattattgatacagcactttatagaccagggaactgaagtacagagggctaaacttgtttaatgaagcgctcacagggtcgagaccggctccagttcactgttgagcactgtgcaggcctgcctgtcagcacagggagagcaacagttgaatttagcatccttcttatctgggggggtcatgagtaggaacgtattcattatattctgaggacttaagtggttgactgaaaacccagagcatttcaggtattacatctagagtttttaacgttacatttagatattacatttagggtttccataatatttgagaataatctagaactgatcatagaataaagtgaaaggaatgcaaatttctagctgattccctacccatttgttgaataaattcgggcaatcaaacaatctgaaatgtagcataatattatggctttggtttttaagatggaaaaagtgatttataaatgaacagattaagaatcagttttttacttttcctgatgggcttttgtggacactgttgtagttctcaataatcttgaatttatgaatgtgccggctaggaaattatcaacaccacatgctgtttcccacactgaaaacttttaagtattgagaaaaaaaatctgtatttatatgggtgataaagtgaaaaatataaaataaaattttcagagttgtgagggatttgtttatgtgctatagaagtatattggagaagttttaaaaactggttggttaaaaaaaatcagttagcttgaattttgagtggggtgtttcagttctagctagtggattgcttaatcatcaacattcagcttctgagaagaaatttcttcccaagtgaatacagtagactcttggctttcccagatttaacattttcagtttctattatttgggaatgaactttaagctcttcaatgtggtgatttgtaattgggtcaaatcataaatatgacagtgagaatgcaagactaatttgttggagccactcctagccaaggagaaagcctgtacccacatcttctcaagtgtgtatcttatggaggaaatcatatgttgtagtggtatttacaaaagcctgaggacatccatcataaatgttaatggtctgctagttgtacttaaactacaacttttctccatgcactcactaacactccctccctccctccctccctcagacctcctctacaccagagcctcctgccaaaccttcccacacctttgtcattaaccctttttatttcaatctctcttttagctggagacctgatttttctactcagttttaaatgctcttaagtatcatattttgtcactctatttgtagcacatctgtcctttcttctggatcttaaatacattctgaatgaaattcagtcttgttttgaaggtcagctttccttctattcaaaccatgtttgtcagttatggcttttggtttgtctttgagggggtcttgttttccctctcatctttatgaatccttacttgctgctctgcaacatgtgtaaatttcttgttcacagcatgtcagcaaataacttgtcaagcttcagtggctcactgtgatttttttctacctccaaagagtatatgagtagattcaataacatgctgtagagccccaaaccaaccctgtgggagaggtcagagttaccctcagattttgtagtagagactcaggaataagtagtgacacatagacagaaaacatcagaatgtgacaagcaatggctgaacccacttgtggattttgcactgccattttacctctttaggcaaaataagaggtttctgtttctgagcctagtctattcccttagaacctttccatgttatcctttatctttatgcaatgtttcccatatgtcagccattcatggccattcaccatcccattttttgttatgagctttcaaactcaaattataatttacgtgatatttaaaaaatttgtctctttaactttgtattcatttgatgttgccttttctaaccgtgaccataaataaaaacccactatcacatggcacaaacataaataagatcaaaagtagtatttttatcatttgtctactattggcctgcgcatttgctgaaactgcagcctattgtttctttcttgaaactggggagtaggaagccttctggttatcagttgctgcaaaacaagccacccaaaacttagtggtttaaaataatactttattactatcactcacatttttgtgggttgacttggctatcctgtggtactcgtttgggtttggcatgaggtttcatttgacagctggggcagggattatctgaaggcttgattgggctggatgttcatggtggttgtcttatttggctgggcaagggctgctacctgttagctgggaccgcctgaagctatttcctgtagtgcctacacgttgcttcttcatatggtttgtcatcacatgtggcagctaagttccaagagtgagtgctcaaagaagtcttcgtggacactgaggtttcttaggatctaggctctgaagtcccacaacatcttaaccactttctattgatttagtctagttcagattcaaggaaaatagtagggaagaatttgtggccatctttttatctatcacagttattgtcagaggggtgttaaagaatagcaaacttaaatgttctttgtgatgtaatcagagggattgaaagagaactgaaaggggaatggcattctaccatgtcatttaatgttatttaattctgtctccattcattgctttaactcatcttggcaccaccaatgtcagtgagcccctcctcaatgtattcaccctcttctgtgatgcttcatatctctttcctttgggatttcaagaagaatttggttgatatgttcttctatcattttgagggttaccttctgtcttttcctaatgctaaaaatacaaagaagaaaggtagaaaagcaaaagtagcattgtaatgaacaaaattagtgttttcaaggcaaacagccaagtattacataagccaactcacagggcatttttacaaaaattctggagaaatggctatgctggtttccagatttagaaacctctctggctcacttgaaaggactacttgggaggagggatcctatcactagacaccttccttcatgggtcaaacttttgattcaagtgtgcatgggtgagatactaagatgaaataatttgagtgtcaaaatctatgtttattatggaaaattttaaggttatattgtttctcaggaataacccaaacagacactgatgactagcattagtgacgttatggccagattatgtgaaaattgacaagcaaatatggtgtagttttcccctcttttaggaaaagcacaaagaaggatccattttgtgaaaaatgcacaaactcttaaggttaaatttagaaccaagggtcatttttaaatgaagtttgatggtatgatttttttgactggtatattgctttatatctgcatctagtcattatatgcatatatttcaaccaaaggtatacagttttagaaacttcctttcatcaagtttcaatttttccttttgcatttattgctcaatacatgattagtcatgagtaagcatccagaatgatatatgtattagctcttcactttggacaagaaatttcttccaatttatataatcactcaacatgacttaattgtcatggttaaatctccttgactctgtactcagtggcattaagcaagcaaatgttgcttatttttcactaagtactaactatgaagagctgttaggagcctctaggaagttaacttacatgaaaattctctcttgaccccattatatttttaaagaagtatagatactagccaatgctgggactatgtcttagataaatattcaagatgctctgagtggaatctgtgctaacattattaccactggtatagtttttgctctgaagatttatgaaatggattattattttgaaagtgttaagcactgttaggggactctcttttttttgacttggactggatcccacaattctaaaagtatttatgaaaacaatatgatgaaatgttaatgatggaagtgtatccttgaactttgattttaaaaaggtgttaaatcactgatgagtccttgtcttcacctttgcttagttccaagattaaactcagtcataaacatgatatttataaagagtttctcataacttagatattacaatagtaaatgaagcaacagaatcgattcacaattatgtatacaactcagtacaacaattcaaaaataaatatgcctagaaaaatacctggaaaaatataccaccatgtcaatagtcattgccttctgtttggattatattgtttcccctttggtaatctttttctttacacttttctttaattttttcaacttttctataatgaaaacattttagcattggcatgtgtcacttaactaaatgagattctgtgattgctaatgtatatgcttcagtgaattgttagtttttaaattatgttaatgaataaacagtttccaggccagtcattttctagcctcattaatgccatagtgacatttgttatactgtactgaacgattttatataagagacttgagcattcttgaatttggtatccttctggggtcctggaaccaatcccccatggatatggagggccgactgtaaacgccttctcctgatttgggttttatacatttgtatcagcagtcttataaacaccctagaaggaagctccaccttccagaagatgaggcagcatgctccttaactgttgaatgaagattctttcctgtttccactctttgtttggtgggcaggaaggctcctgctcttcagttggaagtggctgcagctgttattagcagataagcaggagtggcctggccatttctgtgactcacagtgacttagtgggattcatatcaagaattccttccttttctcttgacagttttcaggtacttcagaaggttaggtagaagggatatgagtgattaagatatattttataggaataattgaaagctgggcatttgatgtgttttgattttagaacagagtactggacagcttcacatttggattctgggcaggtatgaattctaatgagagagttaaaaatagtgctaggtaactagtaaagtaagtgacacagagactttcctttagttcttcgtccatctttgtttctcattcgttgacttgcattgcctcatcctttatctactctatcagtgtgaggttatagaataatagagagaaaaagaaaacaaaaataacatacttaatttcaatttatttattgaatcaaacattacctaaagttgttcttttgacattttttctcctgtgatacacagatgtctcactgagtatcaaatagtgagagggaaaaagattcccatggggtgaatctgcatggaagagtgtgcattaatctgtgcaaatgcctactaatcttggaacttctgaagtaaagaaaaatccattactactgctctatataaatattaacaacctaaaagtaacttaagtgatctgcaatggaatatgtgccatttagatcttttaactacttcacactttcataagacttaccacatatcccaacctcccactttaaatagacgtttttgaaaatatcagtcaaggagaatctttaattactacattgcttcagggaaacatacaattttggtaataagaaacactacttcaacagatctgttcttcacaaaatagagtacatgcaaatgatatgactgaactcaaattcagatgtttggcagttgagctatttggtgaaatgtcttgagggaaagatctttgggttcttttatacttgatgactttaaatctgtgaaaactaaggggctaaaataaaatgaaataactgggtcttttgtttttcttcttaatagtttattgtgtaaagaggcctcgttttcctactataccttattctttgatgcttttcatttccttgtatgttttggaaaaataatgtatgttcatagaactctaggcaccatacagcgacaattggtcaggccttctgagctgcaacacactgcagatgtgaggaagaattgtaatcagtaggtcatctgcctgcataattttcagggagccatcttgctcctaccaggacacatatggaggggcatgtttgcaattttattaataacatttttaactcacaaaagttcccacataaggaggccagcactgtcaaagttcttttttctatctgggaagggcttatttggtttattgtgccttctatgatcttgttttctataaagataggctgctaaaagtggtagacagttactctttactctatgccctattctacatcagtgctgaatgagcaggggctgtggacagaaggtcatgagggaggggtcagttggagggtggcagggcaggtaagtgaagggtttgggctaagtcacattatatgctcaccctcttaagtttcgtgtggtaaattccagctggaataaaaataagagccaccttgattgggaaaagaaactgggaggtgtctcggaagggaagatagagcctaagaagcagtatctattgctagcaagaaagcctgggctccctttgcccccataaaagtgtttagatctggtcggtgaaagtcagacttaaactttcctcacccacctcagagcagcattctggaatagttgctatcatttatagtgctctgaggatatttcaggttttgtttttttctttaaaggataaagtcattgatagaactataattacaaggaggctcagctgttgctgtaggtggtaacaacttataaggcagtctacaccggctgatcttcaattaaattattcatttctgcatgcaaattccacccattcttttcctttttatggcagaagctaccagtacctttatacaaatgatcttggtggggttcctgtcttcctgtttggagatggccttattgagtatgattcaagaaatagacagacctcttgccttcctcataccaacctacaaccatccaaccaaccaaccaaccaaccaaccaaccacccacccacccacccacccacccaaccatccaatcacccaaccaaccaatgatctaaccttttcataggacagaggcctttattcccagttttaaattcagtgggaagcataaaggactatgataaaattatttcttgaatgtcttattactacacaggtcagttgaacatgaaaggggaagtggagaggtttaaattgttaaggttaaaattgtcaaaattggagggctgtggtcattttacataatttacatatgtatattcaattttgtttaaggctagattgtaaaatatcctgcatagagcagaactggactattttaaaggaaattcttttgaatgggtaatgagcaagacatgatgtgaccaaaggacctgaaaaactgccaatttctcagttttaggcttctgtgatcttccccatactttctctgttgggtcattgctactcatattgattgcacggtcctctgatactcactcattccacagttaccatctgatgagatgtggctagtttcagtgctctgattctgttgaatgagattatgcagtgaacttgggtattttcttcagcttgtgatggtttagg

SEQ ID NO: 43 - DNA, 8123 bp, Homo sapiens
aggacatcttcagatcaatccttttcagagtctattacgaactcacagtatcttactcgtagaagaaatctggccataggtatttgtctgacttggcctaacctataattcactcaaagttcagtttagtttagtttttttttgtttgttttttgttttttgtttttttttgagacggagtttcactcttgttgcccaggctggagtgcaatggcgcaatcttggctcactgcaacttctgcctcccaggttaaagcgattctcctgcctcagcctcccaagtagctgggattacaggcatgtgccaccacgccaggctaattttgtatttttagtagagacagagtttctccatgttggtcaggctggtctcgaactcctgacctcaggtgatctgcccacctccgcctcccaaagcgctgggattacaggcgtgagccaccacgcccagcttagttttgatttttgttttttggtttttttggagacagagtcttgctctgtcactcaggctggagtgcagtggcaggatctcagctcattgcaacctctgcctcccaggttcaagtgattcttctgcctcagcctcccaagtagctgggattacaggtgctctccaccatacctggctaatttttttatgtatttttagtagagacggggattcaccatgttggccagtctggtctcgaactcctgaccttaggtgatccacctgcctccaccttccaaagtgctgggattacgggcatgagccaccgcacctggcccagtttagtgttttttttgttttgttttgtttttgagatggagtttcgctcttgttgcccaggctggagtgcaatggcacgattttggctcaccgcaacctccgcctcccaggttacagcgattctcctgcctcagtttcccaagtagctgggattacaggcatgcgccaccatgcccagctaatttttgcatttttagtagagatggggtttctccatgttggtcaggctggtctcgaactcctgacctcaggtgatctgcccaccttggcttcccaaagtgccagtttagttttttaaaaggctttaccaatcatggagaaaataaaattagagggataattttggtgaccctttgctttctgtttcttctcaaacttctcaccttttttcttcttaatcattagaaactgggaataaataagactgatccgagcacactgacagaagaggaagtgagtaaatttgcccgtctcgacatcgacccatctaccatcacgtggcagagaggtgggtgctggggagatgccagcaggctgatggccaggtggggaggcgtgttcgagccgaagcgcttaaattcagaaacttacagtttgatcctgtccagtgatcttcccagcctgtgcttcatattcccaccatttatttcagttactattatcgtaccaccctcccttatccttgcctccaattaaaacaaaaattctgtccagggtcaatcccatctactcctgtgtcttctaaatttccaaggaaaattacctaattttctcttctgtttctctctcctttggcctcttgtatctatattaagaaaaaaaaaaagaaactttttttaaagaccacgcctccctggctttgtcctgctcctcctccacccaccatcccaccttcttctgttcacttccttaccactggctctcggcagctctctgtgtgtttccagtgctggattttcctccaagtctgatatgtgctttcacccacttaacgaggcatcgctccactgcttcacatgcatccaggtggagtccccgtgagctccccaccacctcgacttccctgcttccctctcagttgtgaagtccccttccttctcccacactgccctcagtctcatcgctcactatgggatgagacagagggaaatgcactaaacaggaagttaggagccctgagtgtgtgtctcccctgccactgactcactgcatgatctcgagcaggtcgcatgcatgttcttggcgttggagatggagatggtcacatacgctgcacagaaacacggcaaccacattttatgaaccctgtgcaactgcagaaatgttcaatggcatggatccctgattcttcctggattattcttctcatacttgtgccctcatttacctctttatgctcacatttggaacatatttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaatacgtaatttccatcaccattttcataagtgctgtatcgtatacattgagtaaagtggatctaaattgtcaatgtggacagcttgttatttgaagctgcataaattaacaaagtcagtgtactggctttgttttgttgcattggtattcactaaaccaaacctaattttcacaaaatgtaaataactgcaattcttgttttgttttgttttgagacagggtcttggctgggtgcagtggctcacgccagttatcccagcactttgggaggccgaggcaggtggatcacatgaggtcaggagttcaagaccagcctggccaaaatggcaaaaccccatctcttctaaaaatacaaaaaattagccaggcatggtggcaggcgcctgtaatcccagctacttgggaggctgagacaggagaatcgcttgatcccaggaggcgaaggttgtagtgagccaagatcacgccactgcactccagcctgcatgacaaaaaaaaaaagagagacaaggtctcacttccatctcccaaatgggagtgcagagacacaatcatggtcattgcagcctcaacccccaagactcaagcaatcctcccacctcatttttgtattctttgtagagacaaggtctcactgtgttgcccaggctgttctcaaattcctaggtgaccctcccgcctcagcctcccaaagtgctgggaggtgtgtgccaccacacccagccaataactgaaattctaataagccagtgaagaaaataaagagaactggtacttgctctattcaccattcacccccgccaccccccacaattctactttatttacttttgctttttaaaattgtggtaaaatatacataacgaaatatttttccccatttgtaagcacacaattcatggcattaaatacattcacaatgattgcactatcatcactatctatacccagaaccttttcattatccccaacaaaaactccttatccattaaataattactcccctcttctgcccctgcctattctaggtgcctgatataagtggactcatatagtacttgcctttctgtgtctggcatatttcactatgcaccatgttttcaacatccattcatgtatcaacatgaccttcttttatagccgtctaatattccattgcctgtctgtgccacattttgtttatccattcacctgttggtcgcttcctccttttgactattttgaatagtgctgctatgaacatgggtgtacagatatctgagtgtctccttttggttctttcgggtaatgccaagaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgac

SEQ ID NO: 44 - DNA, 5938 bp, Homo sapiens
tttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaatacgtaatttccatcaccattttcataagtgctgtatcgtatacattgagtaaagtggatctaaattgtcaatgtggacagcttgttatttgaagctgcataaattaacaaagtcagtgtactggctttgttttgttgcattggtattcactaaaccaaacctaattttcacaaaatgtaaataactgcaattcttgttttgttttgttttgagacagggtcttggctgggtgcagtggctcacgccagttatcccagcactttgggaggccgaggcaggtggatcacatgaggtcaggagttcaagaccagcctggccaaaatggcaaaaccccatctcttctaaaaatacaaaaaattagccaggcatggtggcaggcgcctgtaatcccagctacttgggaggctgagacaggagaatcgcttgatcccaggaggcgaaggttgtagtgagccaagatcacgccactgcactccagcctgcatgacaaaaaaaaaaagagagacaaggtctcacttccatctcccaaatgggagtgcagagacacaatcatggtcattgcagcctcaacccccaagactcaagcaatcctcccacctcatttttgtattctttgtagagacaaggtctcactgtgttgcccaggctgttctcaaattcctaggtgaccctcccgcctcagcctcccaaagtgctgggaggtgtgtgccaccacacccagccaataactgaaattctaataagccagtgaagaaaataaagagaactggtacttgctctattcaccattcacccccgccaccccccacaattctactttatttacttttgctttttaaaattgtggtaaaatatacataacgaaatatttttccccatttgtaagcacacaattcatggcattaaatacattcacaatgattgcactatcatcactatctatacccagaaccttttcattatccccaacaaaaactccttatccattaaataattactcccctcttctgcccctgcctattctaggtgcctgatataagtggactcatatagtacttgcctttctgtgtctggcatatttcactatgcaccatgttttcaacatccattcatgtatcaacatgaccttcttttatagccgtctaatattccattgcctgtctgtgccacattttgtttatccattcacctgttggtcgcttcctccttttgactattttgaatagtgctgctatgaacatgggtgtacagatatctgagtgtctccttttggttctttcgggtaatgccaagaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgac

SEQ ID NO: 45 - DNA, 7804 bp, Homo sapiens
tttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaatacgtaatttccatcaccattttcataagtgctgtatcgtatacattgagtaaagtggatctaaattgtcaatgtggacagcttgttatttgaagctgcataaattaacaaagtcagtgtactggctttgttttgttgcattggtattcactaaaccaaacctaattttcacaaaatgtaaataactgcaattcttgttttgttttgttttgagacagggtcttggctgggtgcagtggctcacgccagttatcccagcactttgggaggccgaggcaggtggatcacatgaggtcaggagttcaagaccagcctggccaaaatggcaaaaccccatctcttctaaaaatacaaaaaattagccaggcatggtggcaggcgcctgtaatcccagctacttgggaggctgagacaggagaatcgcttgatcccaggaggcgaaggttgtagtgagccaagatcacgccactgcactccagcctgcatgacaaaaaaaaaaagagagacaaggtctcacttccatctcccaaatgggagtgcagagacacaatcatggtcattgcagcctcaacccccaagactcaagcaatcctcccacctcatttttgtattctttgtagagacaaggtctcactgtgttgcccaggctgttctcaaattcctaggtgaccctcccgcctcagcctcccaaagtgctgggaggtgtgtgccaccacacccagccaataactgaaattctaataagccagtgaagaaaataaagagaactggtacttgctctattcaccattcacccccgccaccccccacaattctactttatttacttttgctttttaaaattgtggtaaaatatacataacgaaatatttttccccatttgtaagcacacaattcatggcattaaatacattcacaatgattgcactatcatcactatctatacccagaaccttttcattatccccaacaaaaactccttatccattaaataattactcccctcttctgcccctgcctattctaggtgcctgatataagtggactcatatagtacttgcctttctgtgtctggcatatttcactatgcaccatgttttcaacatccattcatgtatcaacatgaccttcttttatagccgtctaatattccattgcctgtctgtgccacattttgtttatccattcacctgttggtcgcttcctccttttgactattttgaatagtgctgctatgaacatgggtgtacagatatctgagtgtctccttttggttctttcgggtaatgccaagaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgactaatctgttctctttcagtattggatacaaatgaccgatttctacgaaaaataaccatcgggcagggaaacacagagaagggccattaccggcaggtaggtggtgctttcttcccgggtgtggctctgttcttacgttcatttctactggcctgggagctcactctttgcctttcttgtctcatccccaacctgttgtggccagtggttctctcactgttttgggtgctcagcagggctgggagaggatcagaagacatagaggctccagtgtctttttaccatcttttctatgtatgtttatttcattttctttttttcatgtatgtttccaattgtgtttccaggaagagccactcagggtattctttgaatataaattctcacttattttattgggaaccatccaggtaatactacatctgcataactgataaatgaaaatctcagacacattactcaaatttcatatatcaaagaacaaacacctagttattagacttaatagcatgaggattttttaaaggataatggcttattaatacaaaaatggcttattaataaaatacagagaatgcagaagaaaaattatgtctgacttcattgtaatagatattggatgtgcgtcaatggcacttagggaatacaaattaattcctatgatttttcatccaggcacagtgggcttctaaattgtgttgtgtttttttttcttttgaattgattataaactgtacatttaagaacagttttagatttctgtcctttatgttaagtttttattagtgaaaaaagagtcaccttactataataaccaatccttacgccaaatagacttgtgaccttttgaagtgtcttgaattaaaaagtgaatgtaggtattggattaagaagagaaacttaagttcgtggacctcgtctcctcccagtcctgtaacttacacacacacacacaaacagatttcaaatatccatgctagcaaactggaatcattgccatgaagttttagatagttctgaaaaataggaagatggaattagattgatgattaaaaggacagcccaaaatatggtggacttccatccttaacaagcattcttgcttttcatgttcttagcctctcctgctaaagtgggagctttataaaagcagaggttattcccctttttatttgctgctgtgttccctatgttcagaacagaactttgttacatatagtcgtaagtgttcagtaaatatctgttgaacaaatgagtagaataagtaaaagacaatttatggatacagaactaaaatgccaacataaaaagatgttcatgaataatcataaaactgcaaattgaaacaatggagtatcatttacctaggagcttgtcaagtgaaaatagtaggtactaaatgctagtgaggatgcaatgaaatgggggcatttatgcagcgttagtgggagtagaaatcctttttggatgagtttgttattactaaaatttgaaatgacccaacaattacaactttggaactaaaaatattttaatgaaaagaacaagaaaatgtgtaacgtacaggaaaaaattctgtgtattaggatatttgttgtgccattatttgcagcggtgaaaattggaaacaatccaaatgtccaacagtagagatggttgcatatatttggtccgccattttgtcccatgggagagttgaaattaataaatgtgcgtatgggtgtcttgacatgagtagagagctctcatacaccattggaaaggttgtaaaaaccattttaaaactttgaagtaaaatactgatattgtaaacctgtttatgttaagaaaaacccagcgtgtttacttacattataggcacttacaa

SEQ ID NO: 46 - DNA, 4145 bp, Homo sapiens
tttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaata

SEQ ID NO: 47 - DNA, 5485 bp, Homo sapiens
ttcatgtgaacgttttcacttattttgcactttttagccagagatacagaagaagagagggacactcgagattaaatgttttagtgaaagttaatgggcagcatataacaagcctggggtacttgaaaattcagtaaaaagcaataactagggctggttgttttccctctttgcctttgaatagaaatgcatgcccacactgatggaatgtcaagtgcctgtgctgtaggactacttagcaacctgcccttacaaatctctatcttgaaccagtgtttcttagcattaaaaacaaagggtatgtgtacttaaaccctggagtcagtgtacagaggtctaacttctcacccaaaatcgtgggtcatataatattgtggccaggagagtgcttataggaagtttcaaaattcatttagttgatatattgtggtttgtagtgtacctaggaacattacattattagtaagaggcacatccattataagctcttgggaaggtgtatatttcaacttaacacatttgcagttatatttgaaatgaatgtgtttgcctataaggactcacttagtatctttagttcctatttaatgctaaacttattctgtagacccaaatatttctaagagccttgcatagaggcacctgggatattctgttacaaatatctgttctgtctacacagcttctccaccttaagtggtttaactggtgctttgcagggagtggagaaaggatatctcagaaggtcaaaggattaacattttcccacaaagtctttgatggaaagtctaagaccaggagaagaggagtaataacatgacctattattctgtaatttgcaaattcatgaagggcttccatatataaatttcacgtgtatgtgtgtatgtgtgggtgtgtgtgtgtgtgtgttaaaacctgtgaggtaactataacaggtattattgtccctactttttaaattaaggaaagcaagtctaggtcataggctaagtcattttcccattgtcacctagtaaagtggaccctccacccaggtgttaggatctgaagttctttgcattgttcactttgttttcctcaaacaccttccccttgagcctggagactatatctttcagtctttttacttaaatttctttaagtggctgctgggggtcagtgggaagatcaaggcagtaacaatggaacaggtgtggctgatggaaggctgagatgtcctcagcagcagaacaggatggacaggctttcacactgtttattcatttgtcccctggcaaaacactccttttggtgagccgccttgactgttcccctgggtgttcgcctgcccattgacattcttccccatatttccttgctgctgctctcttctatgtcccactgctgctgctgctggataccatgtttggcacagtaaatcctagagcaagtgatttttcacccttctgttgaacaaggaagtcagggttaaaacacagtaattatatggcggtcaagtgcaagagaggagtgactgcagaggatccctgttcccagataccttttattcctgaatttatactaaatcatgagcatttgtgcatgtcttttaaatatcatttgaagactcttttcatgattctgcacattctatcgcataaatttagcaacatttatttcagtgttctattttgggtatttaggttattttctagtttttgctgtgatgaatattatagaaaaaattaactccttggagaaaaaaactgttaactatttgaagagatacaagtctggtttaaatggtttgccctagtcattgattcatcagtacattgtaagttatttataaccagataaatacatgattagttttctgaagtaatataatagtgatactagttttattttcaggtggaaaaaatgagtaaagatggtcaataacagggatagatttcacaattacatcatcaatattctgaccctagaattttacttttggctcatgcttttataaaaagttggtgcaacagcaatatttttaatgcagtaagttgatacataaatgtataaatctgaaaaatctaaacccagttgtaaataatcaccactttgtaagagtcgttgcttcagtggctggcttaagtatttttggtggaatgtactcctcaacatttgaacttgacttttttttggtcatgcatgtagaaaaggtttaccgattatgagcaaattagtagaagttgaagaaccaattacttagaggtttatttcctggaactactgccttcaatttcttgtgcagttgcatagagaggaatagggtgaggcattacaggtttccataaagctatcagtccctctcttaacttttcagtcagactcacatcttcacccactgtccaacatccagacacaacaggcagtgagcagaccaactttgttcctggtgttctccctcttctctctgggtttcttttttcttttcagtttcttctctgggcttctttttttctattcagtttcttctctggttttcttttttctattcagtttcttctgtgggtttctttttctattcaatttcttctctgagtttcttttttctattcaatgtcttctctgggtttcattttttctattcaatgtcttctctgggtttcattttttctattcaatttcttctctgggtttcttttttctattcaatttcttctctgggtttatttttttctatttaatttcttctttccccaggggaccagtgccttttttcctactccaacctccttaacatggcatccaccaaggcccatatttttgaggtctcattgtctttgggataatgtctttgggacaatgtgtctcttgtctttgggaagcaagttatctttgctgtccccagtcagcaggaagtcacctgactttcccaaatttgacattatcttttccaggtatgtttgcttttaagcgtggtcctagaaatgtcactgccttaagcttactttgattgtgtggctagctcagtgcaagggtcacagcgttctgttctagttttgggtaaactttgatggagaggaccactaggtaaaaatggaattaggaactcatatttttttttttaaaggagggggcctttagggttagaaaatagtgttttttcttttcctgatctatggtggctgaaatgtgtgagcatagggaaatctgacttgaataaactcttaagatgaagtcatacataattaattgcctgtctctgcattctttccaaagtgatggctcttagtattcacacttgtgataacttatgtttcttgagtacaagagcctcaggacagccaattaaggaagaagacacagtggtggttctgttatgtaacctttctgctactgtaatggaatgggcaattgtcttttttttcttaacttccagtgcctgaaacagtacatgcagctggcaatccgagaaggatgtgggtctcccatcacttgccctgacatggtgtgcctaaaccacgggaccctgcaggaagctgaggtatgaatgactaccatcatcttcccctctttcctatttatgttatttattaggatcttgagtctttatgtatttccctaccagggagtctagcaagaaaatacagaggttaactttttaaaggagcactttattgcagcttacctttggactttttatacaaactgttaaagctgtcatttatctcagttctatttacatataccatcttgagtgttgaagaagctatagaataggcaaagtaccagaaatcaaatttaccaaatgtgaagttaggaggctgatatgatttggctctgtgtccccacccaaatctcaccttgaattgtaataatccccacgtgtcaagggtgggaccaggtggagataattgaatcatgggggcggttcccccatgctgttctcgtgatagtgcgttctcctgagaactgatggttttataaggggcttccctgccctttgctcagcactactccttgctgcggccatgtgaagaaagatgtgtttgctttctcttctaccatgattgtaagttttctgagaccttcccaggtctgcagacctgtgagtcaattaaatacccagtcttgggtatttcttcatagcagtgtgagaatggacacatacagaggctgaatagtgaatggtcttgtaaattgtaataccctaaagataaatagaccatggattagctgcagttatggaaaatataaactattgtgattccacaatgatagcctgagttgaaccatttccaaagagtagagacctttcaattgatctgtagcaggcatctgaaatctttttctttttttttcatatcccctcgtttgttcaatcaccggttattggtttgcctttaaatcttcagactctgctcactttaaattagaatataatgaactcttgtttattcttagggtgtttgtaagcctctgaacgacatcccaagaaacagatgaaatcagttgttcatttagcaaacacagaacacctgctttgcaccaggcaccaccaccccccagttgttttcattgccagtatactacctaatcctctcaacagacctcatgaaattgggtgttgctttcagatagggaaactgaggcccagaaggtttaagtaacttacccaaaaccacatatctagaaagtagaagagataggattctaatccattgctttctgactgccataattacgtggctttgagtagaattaggttggccaggtgctgtggctcacacctgtaatcctggcactttgggaggccaaggcagaaggattgcttgagttcaggagtttgagaccagcctgggcaatatagcaagacccccatatctacaaaaataaaaattagaaaattagccaggcatagtggtgcatgcctatagtcccagctactctggaggctgaggtgagaggattgcttgagccctgaaggtcaaggctccagtaagccttgatcacatcactgcactccagcctgggcaatagagtgagatttcatctcttaaaaaaaatgggaatgggggcatagaactaggtaggtagatagaatgtatgataaaggacttaataattggaagctcaatttgtgtgtgtgtgcagacacacatgtagatgtgtgtgtgtgtatagatatatatactgtacatgctttgtttatgaatatatattcttttacatatatatcctttgctttgtaagtgaagcagtcagaaagttagtatagacagtttttaacaatttgtgtctgggcatcctgtgttcaatttattgattagtggctgagtgctacaagtgagatataacgttttttagggaagtataaaaggaatatctgtttagaagtgatttaagaaaatcatggaataacttttttggtaaaaaggtaatatcgagtatgtaaaccctgtggagagatatattattgacttttgtagggtaaaaagagctatag

SEQ ID NO: 48 - DNA, 2166 bp, Homo sapiens
gccatctctgtaaaaacgctaattgataaccgagtcatttacatgttttcgaacacagaatagctcttttctcagcatcattattgctctttcagcatctgttaggacagtctgaatactttctgtttcaaggcactgataaaaccgcaacaaaaacatgtaagaaataaaatagaaatgctttatataatttagtttaaatttatgtatcacctcattgtgacttattttttccattataccattagtcagatttgaataacgaggttttgaaaggataaaaccttttctccaatgacaggattatataattgctattggcaatgtagcctggtgcttcatgagacctatgctaaatgttactggagagttcttgaagccagggataccatatcaggaactattcaggatctatgatattttctgaggtaactgggtaatagaatatcaaattgctgctatctcggacctattgttaaaggatgatgctttgcctatgtaataggatatatcctaagtggggatgtgtatatttcaggaactttaattcacaagtatatattgatatctgatgtgtgtatagtacatctgttggttatgtacattttaatttacatgttgtgtagaacatagatgagaactctgggaaaacttgggaatggcaaccaaccaaaatcatttttaatcatttattagaaatttctcaatattgtgtctttttcttttgaaactctaaacacttcagaaaaaaacactatcagtgtagttcatgttagtataattatagatttacatatatttgaatagttaatttgctttgttttacacgtagcccactgcctcattataggtaaaaggcatttataactgctcaggggattacgagaactcaactgaaactgaatttttgtaacaagaatgttaatagtggcaaagtcctctgtcagtaaactctttaagcttggtgctgcaaagagtctttaaatgggggctgatttcaagtaacctaaaagactgtgttatcagaggaagaggtcccaaatttggagtaaagatgggagaaaataaatatgtgctatttccttggcgagttgagggaatttgccaccttacagagtttgtatcactgaattagctgcttttgtttttttttttttttttttgccagggctatggagtgggggttgtttgtcaaactgattttcaataattggatttaattttttttaacattgaaaagtgcctgaaaaatggtaaattcttaaatgtgtgtgagattgtcagaatcaacaaaactaggttggttaaacatatctctggtacatcaaggggcatgatacaaaccagtctaaagactgtttataaaggagagagctggcgacttatttttatttttattttttggacagagtctccctttgtcacccaggccggagtgcagtggcatgatcatggttcacttcaacccctacctcctgggctcaagtgttcctctcaccttatcctcctgagcagctgggactacaggcacacaccaccacacctggctaagttttgtattttttgtagagatggggtttctctgtgttgcccagtcttgtctcaaactcctgggctcaagcgatccacccaccttgggctcccaaagtgttgggattacaggtgtgtgtcactgtgcctgacagctgacagttttaactgacaactttgataacagaggctgctatttttgttttagataattggccagtgacagagtttacccttgcctcctttcttggtctgccagctttgtcctttctgagtgattctctttctgtattgagaggaagtgtgggtctacatagggatgtttggatgctatggcaagaatctttttgtgtttggagtgtagtccatttgcaatagaaataaaaaaatccgtcaccaaattgtaacctggatgttatagcccagcatctagaaatcctatgaaacgtattagcacaatatcttgccattgtcccatctaggaaattttttcttgttgtgaggtagggaagtgaggaggaaagccatgccgaagcaaatgttagaatcttaggcatcctatttgttcatgccatgggtatttgctttggacttggagtctgtactttgaaagaggcctttgaaaaacaaataatt

SEQ ID NO: 49 - DNA, 9129 bp, Homo sapiens
agccattccttttcaagaacattacatttcctgatatatttcataaattgcaaatgctcttaaacaatcagactaatatatccttcctatcatcattattcatattaacctatcctcacagaaagaaacctctaagagatgaaaaaaaaaaaagtgtaagaagcatgtcaagaggctaaaaaccactacttaacaaaacaatctttttttctttttcttttttttttcttggagatggagtctcactctgttgccaggctggagtgcagtggcatgatctcggctcactgcaacctccgtgtcctgggttcaagcaattctcctgcctcagcctcccgagtagctgggattacaggcgtgtgccaccacacgcggctaatttttgtatttttagtaaagacgggatttcaccatgtttgccaggatggtcttgatctcttgacctcgtgattcgcctgcctcggcctcccaaagtgctggaattataggcgtgagccaccacacccagccttttttttttctgagatggggtctcactctgtcacccaggctggagggcagtggcatgatcttggctcactaaaatctcaaaatctctgcctcctgggctcaatgaattctcccacctcagcctcccaaatagctgagacaacaggcgtgtgccaccatgcacggctaatttttgtattttttgcagagatgggttttcaccctgttgcgcaggctggtctcgaacgcctgagctcaagagatcctgccacctcagcctcccaaagtgctacgattacaggcgtgagacaccaagtgataaggtttgacaaatctcatcttgaattgtagctcccataactcccccatgttatgggagggacacggtggaagataattgaatcatgggggcagtttcccctgtactgttcccgttagtgaataagtcttacgagatctgatgggtttataagtggaaacacctttcacttggctcttattctcttgtttgccaccatgtaagacatagcttttgccttcttccattattgtgaggcctccccagccacgtggaactgtgagtccattcaacctctttttatttataaattacccagtctcaggtatatctttatcagcagtgtgaaaatgaactgatacaccatgcctggccaaaaccaaaatcttcttaactcatgttccacatttaaatatatggtagcagtggtgaaggagagtgaagagaagttttgaattgttatagtatacatgcacacacaggttcacacgcacacacaaaccattttgtaaggggaacatttattttaaatcttagccatgtgttaattttcacttaatatttgtaggaacattttcagttacatgttcaacataataccattttaatactagtattaaaaatgttttataaccctttataacacaggaaaacacaggtttctaccaatgggcagaacttgtcatcatgggggattccagtaaaagactatttcccaatctgctacgtacagccgactgcctaaatttggaccaatggatttggtgtgtgtgtgtatggtaggaagttgttttctcctctctaggttttccttctcactgacgagataatagcaacaaataaaggctcccatctttaattcagatgaagaagcctcctgatgagaaggacagagctgcctggccagcttcagacaggtcatttctagattgctgtctgagtagaacagaaatgtctgttatttcagcactgaaatttgaagatattgttatagaaaattttaacacaaaagtctaaatattcagttaaattatttgtaggaaatagttcaatcaatgtcattagtcaaggcaaaaatctttgtcataagaattaggggataaaaacaaaatcttaaaaatatgtacacatgaatttttatgtatatgctcatgtgacattaaaggtctctccaggcattacatcagcagtccccaacctttttggcaccagggaccattttcttccatggattggggtggtgaaggtggatgactttgggatgatacaagaacactacatttattgtgcactttatttctattattactacattgtaatatatagtgaaataattatacaactcaccacaacatagaatcagtgggagccctgaacttgtttttctgcaactagatggtcccagctgggggtgttgggagacagtgacagatcatcaggcattagattctcataaggagcacgcaacctagatgcttcacaggcacagttcacaatagggttcatgctcctataagaatctaatgccactgctgatctgacaggagatggagctcaggcagtaatgcgagtgatggggagtggctgcaaatacagatgaagcttctcttgcttgcccactgctcatctcccgctgtgcagcctggttcctaatggtaccattctgtggcccaggggttggggactcctgcattacatcaaagtaaaaatcacacacacacaaagaccaagatacttacagtaataaattttctaaatagttgaatgtcaacactatgataaacaaaattgcaatgcaactaactggagaaaaccaatttagtttagggtttttgtccataatacatgaaaaagctcttaaaatgggtaaaatgacaaagaacattgtattaatagatttttggttgcaagccacagaaaccaagactctggttaacttagatgaagtgaattactgtaagagtatgggaaagttaaatgaaagaagaaacagatgcagaaaggacaacggaagtagttccagagggtgctgctggcaggaactaccatactgtcttccctgagtactgccactggaatggacagttccttagaaacagactgaggtggcatagagatggcatagagaaagcatagagaaatggcatagaggaagtttgattgagagtatactcaggagacacaactataaggaaatgaggaaggcaggattgggcagaggaagcagcagactcacagtgaggatgcagctgaagcctcagtccatcctacagggtgttctttgaggtagtggctctttagattgtcccaaatacagtcaatgccctttatattgaccatcagctagtcagtggccttgggttgccctcaggcaaggcagttgcccagggagggaggaagtgagatataagcaactaagagtcccacaactggacttacttttctgactttgcatcacaccacccaaaattcaaaacacttatgagagccagattggcacatttggtcatatgctcacaatttggctggggcaggcaagctcctctattatgtccttccaaaactacacacagagaggtaattccagtaaaagaattacccccacctcaccaaagaaacaaaacaaaacccaaacaaaaacaacaagaaaaatgtgtatgctattaccacaacaagagagaatggaaaccccacttctaggatacagtaatggtcttctatagatatcaatgggcaattcagaaataaaaatatataaatgattaagaaactttaaaaactataacctcactagaagtcaatgatctgcaaattaaacttttgttgttttttttttttgctaatcagattgacaaagattaagaaagattttactctgactttataagggtggtggaaggcagaaattcaaacacaatgttgacagaaggataaattgataataacctttctgaaaatcaattttgatatgtatgccaaaagttttaaaaatatacataccctgctatttcacttctaagaatttatcctaaggaaatactcaattaagaaagatatatgcacaaagacatccaatgtagcactgcttgctcttatttaaaaatgaaataaacagggttcaaaaataggtgatagagtcagtaaattatgataaatctacatgatgcaatattatgaagccattagaaatcatgcaattgcaagatatccattttcatatatagagaaatgttcacattactggttttaaaaactataaaacataccataaatcattttgtaataccataaacaggaaaatgttatttcagggtgatggcattataagtgttacttccttttgcttttttcctatgacttctatattaattattactttataaatagaaagatgttataaataataaatatctacttgacttatagatattaaattcttgatatatatcctattatatatcaagaattatatattatatcaagaattatataatatggaatatatatcaataatatctatctatattatataatatatattaagaattttatgtctctagaaattggttacaattcaaccaggcatggtgggtgtctcagcctgtaatcccagcactttgggaggtcaaggccggcagatcacttgaagtcaggagttcgagaccagcctggccaacatggtaaaactccatctctactaaaaatacaaaaattaaccaggcctgttcgtgagcacctgtaatcccagctacttgggagattgaggcaggagaatcacttgaacccgggaggcagaggttgcagtgagccgagatcatgccactgcactccagcctggacaacagagagaaactcagtctcaaaaaaaaaaaaaaaaaaaaaaaaaattggttacaattgaggtggaattttagttcaaatctcttaaaaaacaagaaacatttcttgactaatcagaagagctgatactcagggccatattcaaagtcagctggtacttcagttttaaatgaaaacaattacatgaaccgtaataacctgcctttaccttcatactcatgtttttaaaaactgccatattgaacctaatagttttggcccacatttaaaggaagattaaattacttggaaagggcccagaggacagtaataaaaataattacatacttagaaatttggtcctataatgacatgcaagaggaaatcatttagaaaataaaactgaaaataaccttacacttttacgggttaccataacctctgaagaatgggacaagaagccaaagaattgaattataatgagaataatttaatttagtcattaggaagaacatcttattcctcaataagtatttgagtgattattaatgtccaatgctatggcataaggacttgtaaccactaggatgtgttactagaaattattttcttaaaagtgtcagaggtagaatattgtgcaaagtaggggcttattacataaccctttaagatcttttccatatttatgatttttacaaaatttcaggcatctagaataattataaaaacatatcttatttttatggctttttaaaagtgaaaatagattaataattaagaaatataagaggataaaaatattagagatttttcattaacattgaggaaaatataagtatacagttagttaggaaacgcattatattatttgactccataaaggggaagcaattaaactaattattaagatatgagtacatgtgtgttaagtgtcagtatttgtattttaaatctctttttttttaaagtatagtgcaatgtagtgaatgcagacaaaatgttcctataacatatctgtacagatttttttctaagacgggagtcttgctatgttgtccaggctggtcttgaactctggggctgaagcgatactcctggcttagcctccctagtagctgggactacaggcacacaccaacttaccagtaacacattagttttaaggggctcagatgaaggaaaataaaatggatttaagatgagtaaaaaagaatcctcctttgtctgggcttgttccatcttccaaatatgtagcagcaacataatgacactaaaaactgccctaaaaatctgtaacagaaaaaaaaaatagcttacatgctactcaaaaaattacctaaatacctctcaaaatcaaaacaaaaagcaaagtaaaaaataaaacaggacatacttgcaagaaaagatatgacctaaaggttgtatcttagccctgtttgttttttgaataaaatattaagttttaagcatttatttactgtttacatacattaggccttaccatattatcaggcactattctaagtattttacgaatagtactttatgtaatcctcatagctccacaagtatgagggtgtggtggctcatgcctgtaatcctagcactttggaaagcagactgcttaagtccaggagttcaagaccagcttaggcaacatggccataccctgtttctacaaaaaacaaaaaaattagccggggatggtggcctgcacctgtggtcccagctactcaggaggctgaggtgggaggatcacttgagcctgggagatcaaggctgcagtgagctgtgatcttaccactgcactccagactgggtgacagagcgagactctgtctaaaaaaaaaaaaagctaccattgttataccccattttatagattaggaaactgaggcacagaggtcacactaagccaagatcacacaacaaatagcggagctgatggagctgagattcaaatccaggcagtctggtgctggagtccatgtgtgtaatcactaagctattatatacaagtaattccttcaaatattaatatttgataacaattttgaactttgaagtttgcaaatatccacagcctgtatagttagaagtacaaaagtaatcacaaataacttttctaatacagattttaaattggaaaagatttctttgaatagctttacaacaaacatgtgtagacaaaagtagggataagaaagaaagactgttttttaaatgcatttgtcatgaatttactacctgggtaagcaaaaaacttgagctgtctcttttgaaagacataatttacaaatatgaatttatatattgtctagaggaaaagcacagtacaatttcaattaatgtttaattctatgactgactaaaatctttataatatttttaattaaagaagaaggtgaccgggacttaggtaagaaagcaaaattataacatttactacataacaagttttttgtttttttttttacataaacaagctttgtttcttacaaaaaaaaacaagcttcttcttttttttttttttttggatacagagtctcactctgtcgcacaggctacagcatagtgccgcagtctcggctcaatgaggcctctgcctcccgggttcaagcaattctcatgcctcagcctccctagtagctgggattacagacatgcaccactacacccaactaatttttgtatttttagtagagacagggtttccccatgttggccaggctggtctcgaactcctggcctcatctgatccgcctgcctcggcctcccaaagtgctgggattataggcatgagctactgtgctaggcctataaaaaagcttctttagggtaacttttttcttttttctgtaacagaataatcacattatttctcaagggaaataccatttactcaatttgtactctgaatgccatctaataaaacagcaaagccacaaccatgcagaatgtcagcacagcatgtctaactaaaactcactgtaagaaaaaaaaggaaaagagagctgatttcaaaggttctacatggctttgcacttcacatgctctgatgctgcagatatgagaagttgtaggtctaacataatttatatcttcttttaggatactttggcatttgtgaattgagaagtttggaaaacaactacgcaagtcacttctaatcctaaaattccaactacatgaaataaatattagtaagtactcagacacacacaatgtcaaaggctggccttgtggcaaaaaggaaatacagcaaaatcagtcaggttcccaccacggcactgatagcaagtctgttctcaaggttagtctctaaactgacacctggtaagtctgacaatgaaatatttgccaacaattaagtaaaggagatctctcctgataaatttttcataagtttcacataatacactttgatatttcctggaatgtttgtggccctcccctcactgcattgctctctcattttgttggctaatacatgttactaaagtcaatatatattcaactcatttttctctgcctcttggcccaatttaacacagctgatcctgttttcaaatgccttcatctgattttcttctcacctcctgacctttgtaggtcttttatgtgctcattaatgttggaattacttattttttccttaaccaagtttttcatctgtaaaatggatgtaatcttatgattttcttcatagtgttgcgagaattcagtaagattatgaatgtatagattttggcacagtatccaggacctaaattctctataaaggctaactactattactactatcaactcacagctagattagtgaaattgtgtcctgactttccatgcttattcttcctcttctccactcttctgctcataatataactagttttatttttatttatttattttttgagacagtgtctcactctgtcgcccaggctgggtgctgtggcacaatcatagctcactacaacccccacctcaagtgatcctcccacctcagcctcccagggagctgggaatacaggtgcgtgccaccacgccccactaatttttgaatttttgtgggtttttttggtagagatggggtttcattattgttgtccaggctggtctcgaattcctgagctcaagccatatacccgccttggcctcccaagtgctgggattacaggtgtgagccaccttgccaggcctagagagttttaataagcacaaatctgattatgtgcccctcaatctatccagaaacccattaatgcttttatagggcttttagaatacagacacatctcttactacttttgcccccaatccttccctatgctttaaccaaactgatttcaagcttcttgcttctttgatagtccctgctcactccatgagggcatttgtccacaatatttcccttgttggaaaccctctagtgacaatttggtcctaattttcctttagacctttgctaaaaagtcacttctgtcttgactaagtctggcctattttgcattttccttata

SEQ ID NO: 50 - DNA, 1588 bp, Homo sapiens
agccattccttttcaagaacattacatttcctgatatatttcataaattgcaaatgctcttaaacaatcagactaatatatccttcctatcatcattattcatattaacctatcctcacagaaagaaacctctaagagatgaaaaaaaaaaaagtgtaagaagcatgtcaagaggctaaaaaccactacttaacaaaacaatctttttttctttttcttttttttttcttggagatggagtctcactctgttgccaggctggagtgcagtggcatgatctcggctcactgcaacctccgtgtcctgggttcaagcaattctcctgcctcagcctcccgagtagctgggattacaggcgtgtgccaccacacgcggctaatttttgtatttttagtaaagacgggatttcaccatgtttgccaggatggtcttgatctcttgacctcgtgattcgcctgcctcggcctcccaaagtgctggaattataggcgtgagccaccacacccagccttttttttttctgagatggggtctcactctgtcacccaggctggagggcagtggcatgatcttggctcactaaaatctcaaaatctctgcctcctgggctcaatgaattctcccacctcagcctcccaaatagctgagacaacaggcgtgtgccaccatgcacggctaatttttgtattttttgcagagatgggttttcaccctgttgcgcaggctggtctcgaacgcctgagctcaagagatcctgccacctcagcctcccaaagtgctacgattacaggcgtgagacaccaagtgataaggtttgacaaatctcatcttgaattgtagctcccataactcccccatgttatgggagggacacggtggaagataattgaatcatgggggcagtttcccctgtactgttcccgttagtgaataagtcttacgagatctgatgggtttataagtggaaacacctttcacttggctcttattctcttgtttgccaccatgtaagacatagcttttgccttcttccattattgtgaggcctccccagccacgtggaactgtgagtccattcaacctctttttatttataaattacccagtctcaggtatatctttatcagcagtgtgaaaatgaactgatacaccatgcctggccaaaaccaaaatcttcttaactcatgttccacatttaaatatatggtagcagtggtgaaggagagtgaagagaagttttgaattgttatagtatacatgcacacacaggttcacacgcacacacaaaccattttgtaaggggaacatttattttaaatcttagccatgtgttaattttcacttaatatttgtaggaacattttcagttacatgttcaacataataccattttaatactagtattaaaaatgttttataaccctttataacacaggaaaacacaggtttctaccaatgggcagaacttgtcatcatgggggattccagtaaaagactatttcccaatctgctacgtacagccgactgcctaaatttggaccaatggatttggtgtgtgtgtgtatggtaggaagttgttttctcctct

SEQ ID NO: 51 - DNA, 3228 bp, Homo sapiens
tctaggttttccttctcactgacgagataatagcaacaaataaaggctcccatctttaattcagatgaagaagcctcctgatgagaaggacagagctgcctggccagcttcagacaggtcatttctagattgctgtctgagtagaacagaaatgtctgttatttcagcactgaaatttgaagatattgttatagaaaattttaacacaaaagtctaaatattcagttaaattatttgtaggaaatagttcaatcaatgtcattagtcaaggcaaaaatctttgtcataagaattaggggataaaaacaaaatcttaaaaatatgtacacatgaatttttatgtatatgctcatgtgacattaaaggtctctccaggcattacatcagcagtccccaacctttttggcaccagggaccattttcttccatggattggggtggtgaaggtggatgactttgggatgatacaagaacactacatttattgtgcactttatttctattattactacattgtaatatatagtgaaataattatacaactcaccacaacatagaatcagtgggagccctgaacttgtttttctgcaactagatggtcccagctgggggtgttgggagacagtgacagatcatcaggcattagattctcataaggagcacgcaacctagatgcttcacaggcacagttcacaatagggttcatgctcctataagaatctaatgccactgctgatctgacaggagatggagctcaggcagtaatgcgagtgatggggagtggctgcaaatacagatgaagcttctcttgcttgcccactgctcatctcccgctgtgcagcctggttcctaatggtaccattctgtggcccaggggttggggactcctgcattacatcaaagtaaaaatcacacacacacaaagaccaagatacttacagtaataaattttctaaatagttgaatgtcaacactatgataaacaaaattgcaatgcaactaactggagaaaaccaatttagtttagggtttttgtccataatacatgaaaaagctcttaaaatgggtaaaatgacaaagaacattgtattaatagatttttggttgcaagccacagaaaccaagactctggttaacttagatgaagtgaattactgtaagagtatgggaaagttaaatgaaagaagaaacagatgcagaaaggacaacggaagtagttccagagggtgctgctggcaggaactaccatactgtcttccctgagtactgccactggaatggacagttccttagaaacagactgaggtggcatagagatggcatagagaaagcatagagaaatggcatagaggaagtttgattgagagtatactcaggagacacaactataaggaaatgaggaaggcaggattgggcagaggaagcagcagactcacagtgaggatgcagctgaagcctcagtccatcctacagggtgttctttgaggtagtggctctttagattgtcccaaatacagtcaatgccctttatattgaccatcagctagtcagtggccttgggttgccctcaggcaaggcagttgcccagggagggaggaagtgagatataagcaactaagagtcccacaactggacttacttttctgactttgcatcacaccacccaaaattcaaaacacttatgagagccagattggcacatttggtcatatgctcacaatttggctggggcaggcaagctcctctattatgtccttccaaaactacacacagagaggtaattccagtaaaagaattacccccacctcaccaaagaaacaaaacaaaacccaaacaaaaacaacaagaaaaatgtgtatgctattaccacaacaagagagaatggaaaccccacttctaggatacagtaatggtcttctatagatatcaatgggcaattcagaaataaaaatatataaatgattaagaaactttaaaaactataacctcactagaagtcaatgatctgcaaattaaacttttgttgttttttttttttgctaatcagattgacaaagattaagaaagattttactctgactttataagggtggtggaaggcagaaattcaaacacaatgttgacagaaggataaattgataataacctttctgaaaatcaattttgatatgtatgccaaaagttttaaaaatatacataccctgctatttcacttctaagaatttatcctaaggaaatactcaattaagaaagatatatgcacaaagacatccaatgtagcactgcttgctcttatttaaaaatgaaataaacagggttcaaaaataggtgatagagtcagtaaattatgataaatctacatgatgcaatattatgaagccattagaaatcatgcaattgcaagatatccattttcatatatagagaaatgttcacattactggttttaaaaactataaaacataccataaatcattttgtaataccataaacaggaaaatgttatttcagggtgatggcattataagtgttacttccttttgcttttttcctatgacttctatattaattattactttataaatagaaagatgttataaataataaatatctacttgacttatagatattaaattcttgatatatatcctattatatatcaagaattatatattatatcaagaattatataatatggaatatatatcaataatatctatctatattatataatatatattaagaattttatgtctctagaaattggttacaattcaaccaggcatggtgggtgtctcagcctgtaatcccagcactttgggaggtcaaggccggcagatcacttgaagtcaggagttcgagaccagcctggccaacatggtaaaactccatctctactaaaaatacaaaaattaaccaggcctgttcgtgagcacctgtaatcccagctacttgggagattgaggcaggagaatcacttgaacccgggaggcagaggttgcagtgagccgagatcatgccactgcactccagcctggacaacagagagaaactcagtctcaaaaaaaaaaaaaaaaaaaaaaaaaattggttacaattgaggtggaattttagttcaaatctcttaaaaaacaagaaacatttcttgactaatcagaagagctgatactcagggccatattcaaagtcagctggtacttcagttttaaatgaaaacaattacatgaa

SEQ ID NO: 52 - DNA, 1828 bp, Homo sapiens
tgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttc

SEQ ID NO: 53 - DNA, 101061 bp, Homo sapiens
  misc_feature (512)..(100511): n is a, c, g, or t
ctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttatta

SEQ ID NO: 54 - DNA, 3481 bp, Homo sapiens
ggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactctttt

SEQ ID NO: 55 - DNA, 42920 bp, Homo sapiens
tactggaccgactgggaaacaaagtccattaaccgagcccacaagaccacgggcaccaacaaaacgctcctcatcagcacgctgcaccggcccatggacctgcatgtcttccatgccctgcgccagccagacggtgagcaggcaaggggtgggagcaggcgaacggtgagccaggcaccggggtccctgggagttcctgctcatcccttctctagcattgaccaagccctcctggccagacactgggagactccaggagggtctagacaggggatggtctggctcccgggagcttcagcccggcctggatccagccctggagtctggcagcagcaagtccctgaggccagtcaagtgggggtctgggtgcccagcccccagaaggaaggcaggccggcccctgggagggaagcacagaggaggtggggagctggccttcaggcctggcctgatcctgggaccttagaatcctctcctatctccagcttcagctccctcctaaaagaggcagggttcagacccacccgcctctgtccaggatagagtgagtgaggcagcctttggtaggccagaaaatgtcaccatatttcacgacgttttctctggcagtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccaggtgaggctgtcccccagaccccatcaccagtgcccgctccccaacccccaaatcctccttggaccccaacacctgctctgtcctaatgtcctcatgcatctggttttcccacactaacacccccacatttcttgcctacctcttgtctccccacagcaatacttttacccccgtcacctcacacagacacctccacaccctaaccttgaccctccttgccatgcttcagtgctgccttccccaccctatcccacgcagccccatacctggcctttccgaactcaccatagcccaacctgccccataacaccctgacccctgcctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaaagaaaaagaaaacaaaagggcagtgcgaggggcaaaggttgagagtggggcagggggcagtcttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaaaaggccaaaaaaaaaaaaaagaaagaaaaaaagccgctggtgtctgcctgtgtgtgagagacgctgggagctggggctgcgctttcctgcttcggccaccagagggagacctgccccgtgctggaggcaggctggcgcgtggtttttagtgcccttctcccagggccctccccctctccatcttactgtgcccgggaagcgggtggcactggacttgacatggaagatctgcttctcctggctgtgtgaccttcagccatgacttcgagtctccagattttgtgttccctctgggtctaggacactaactcagatctgtttctctgcattcacttctaccagacaccacccccctacccaaaatgatcacccacagtgagaagccccactataagaagtgaatacactgaggctgcaaaggttttctcatccttcagggtcctcccatgcggttctctctgcctgagtctgctcttgaagcactgacgtctcactttgtggagactaatgaatcaaatgcgaagtaaaatgctgcattccagagccaggtgtctcctgcggtaaaggagagctgggaagaccagtttgccaggccctctaggcccccagcagctccagctcaccaatcatttcagtcattccagggggtaacaggaaaaaactgtcaatcaaaagtgtccaggtccatttcaacccctgcctagagggggaaacttcttgcagaaagttgcacagtttacactgcccaggactagagagggtttgagtcccagtacagcaaatatgagctcaggaagggtggctgcaaatgtctgaagatcccttacccaactcccaaccaggaagtgctgcctttcattcctcctccctcactggttcaactccaggagattcctcccaggcttccttctgccttggggaagctacaagtctaggcacctgtggaaagaggagccctccccttcccttcttagccttcagaagctctctccaacctcatcctccaagccaactctgagatcctcccctgccttcaaaagggccctggatgggcaactgcggggaaacagaatccgtggttgccgagtaggaggtctgtgtcccaatctggccaccaggtggtgtctgtacgcctggagcaccgcctatcctgaagccccacacagcccccgcctcagcactcattatgcacctgcgggggaccccagcccagtctctcgcttccttctctccggctattttgccacacccctccaccctctgccagccagctcccctccctgccccagcgcctgcctgctcccaccaccaccagccccaaccctgcccctctgccatcggtgcatctggtgccccccgggagccactgatctctgcctgtcacctcaagatcctgggcagagcgacaagggacccccgctgcagcttggaaggcatacccctccagtcagcatcccccactccgcctgtcaggacctgctaggagaaggtccaccaggaggcagtttctcaaactacccacccgggaggcaggtgggaagccctcaccttggcctgagagatgggaagaaccagggacagaggctgagaaccagggacagaagctgataccgaatgagaggcagaaacccagaggcggagagacagggggacagaggcaaagacccagagacagggcgagtagtgtgcatgtgtgtgtttgcacttgtgtttgtgcgagcgcgcacacatgtgtgtgtgtaactggagagagaacaggtggcctgagactgtagctaaaggaggagagatgcagtgggttcggcccccagaagaccaggaccctggtaatgggcttctgtcctggacagcctacgcctaggtgtgcccactgttcccacctactactgaagcagcccccgtgcctggaacgtgggctcagggttctggctcaaggccttttggccttgagcctgaacatttctgccccttcctgcctctctcctctccacccccaccccggcacccaggttcctgcctcctggcttctgcctgtctccctgggtgtctctgaatctgcctcgtcctctcagcaccggtccttttcctgactcgtgtgtgtggctgtcacgtcccatatctatctgtccatttctttgtatgtgcccccacttgtcttctgggctgccagtgacagcatacacctgtgtatgtctcagtgtgtgtgtccacctctgtgggtgtttgctctctgccaagacaaagagagggtgagcgcactgagcaactgtctgggtgtgctcgtctgggtgcaggtgtgctcacctctgttgctgtgctcctctgtgtgttggggtgccgctaggtgtgcgcctgtctctgtatttcgctctgtgtgccctgtccccgtgaaggcatctgcgtgcatccctggggtgggctctcaagggatgtgtctgtctctcagtctctttgcttgtccctatctctgtctaggtgttggtcataccacaacctcagccacagcctcagtgcatagcaacagctgacagctgaaaccacccgggcaggagagagagaggcagtggggaggagggaaccgaggaagaaacagagaagaggatgggggcagagagctggggctggggacagagacaaggacagagatagggaatggggacaaggatctagaagagctggtggtgaaagatgggacggcgggaggggaggaacagagactgcaccaagaggccaggcaggcggcgctgagagggatttcctgcccagcccccatgcagaggcgcactgggcctcgtgggggtcagtggtgggggccaggggcaaaggtgaacagccggtctagccgaggggtcctgagaccgcagaggtgcggtgaggcggggacggggcggagggcgccgtttgtcagccctattgacagacgtgatggggtttccgtccgtgatcaatgattctcatctccgggccgaatgagccgcggggcgcccatccatccccgtcagcatcgcgcggcggcagccgcccgaggccccgcccgtccccacctcggcccctgccctgcgcctgccccgacacaccttggccctgaacagggcagaggcccggggcttggagagcgtcgtccggctgggctccgcggcgcccccactccaggtgcacgggcccggagcccagagccccacgccctgccccgttcctcctgggcgcacagacgcggcctctcgggggaccagtgcctgagcccctcgaccccctccgcttcgcacctgggccaggggcgtgtccggggcgtgccggtgtgaaagtcaccttcggtgcccccagctgggcgggagggggcgcgcggggcgcggccgggattggagcgccgcggagccccgccccccgcccgcggagtcagacccaactttctcccccgcccgcgccccgcccccagcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggtaagagtggcagggctggggcgctagcgcgggcgcggggttccgggacgcgaaggtcccagtgtgcgaggggctccgtgcgcccgccccgcccccagctccgagcgtcccaactttgcgcggcgcgggggaagcggacagacagactgcccgattcaggacgggcactctcctagcgcaagttggctgaggcttggagagggtgccgggcggaggtcccccttgcagccgacttcaggcgcggcgggggaggggacgaagcccgacccgcgagtgcgccagacagagcgggagtgcgagacagacagacaagccagcagggtgtcagccttgccgtctttccgcgccagtctcgctcgcctgcctcactgtctgtctgtccttccacccctccacccccgccttcccatttctcttctctgcacttgtcaccatgccaggtgggctctgtgtcgggagcatccatggcccgagcacacacgcacacacggactcaggcagacacggctgaacttggctacagccagcctcccatcacatttcccacggagacaccatctcccctgcacgacctcacagacacacccccctctcgtgccccactgaagggggaggctgtctggaaggggagtctctcctcccatgccctccctgcctccaaccccactccaaggcctctttccctgaggctctcgggcgaagagccagaggctaagggagctcagacttgatctgcctccttcctgacttggaggcttcaacctgcgaacatgctgtgctcatatgtgctgggtggagggcgtgggtcaccgtgtgcacctgtgtgcatgtgtccagggaagccaggcttggtccagtactggggccgagggtacatgtgtatactggtgtggtgtgtggtgttggctttgcatgagtgagtgtcagtgcctgcctcacagtgcagccatctgcctatgcccctggtgtgtgcccgcaatgggggcccaggccccagtcccccattttccttctaccagcctcccctgcctatggcttccctgttttctgacccccaactgtgacctacctagtttgggggcaggcaggtcattccccaaaccctcattctctgtaccctcagcccctgtagagtctagaaggggtgtatttcttcccccaacacttggacctctgcctgctcagccaaatcacatttggcaaaccccagcagggcaggggctgccccagtgaagctagcattagagctccctggccctcccagccccacctggtgaccttgaggggctgcacggtaggcagaggagcccctccatgaaaactgcttccactagcaggagcttcttagggacttgctgcccaactctgtccttagtgaactggaggagtggggggggtctgtgccctaccacccacccacccatgtgtgaaggcctggggtcaagaggtggtaggtatggcattctcttgcccctcctttccacttcctcccacctcatctccactctcccaggcaaataaactcccctgtggacagatctggtttaatttcctttgccccctgagggggaatgaaacatctggtggagacttgagtgagagtgagcgtgaggatatgagcaatgggatctatctgagtgtgtgtgtgtgagctgcagctgtggggcctccgtgttggagtcaacagggagagtggatctgctggttagcccagcttatgtgcatgtgagaatgtgtttacatgtgtacacactgcgggtgtgtgaatatgtataactgcacggggaggtgtgggtatatgagtgtttgtgtgtccaaatacctgtgtgtgcttctgtgcacttgtgagtgtggcgtatgcacatgtataccccggggtttctggtgcatctgtgtgctggggcccatgtgttgtctgtatgagtctctggggtttgtgagtgtgtttctgtgtgcttgtgattgtgagtgcatttgagtgtgctatgagattgtgagcctcaggatgtgtttatgtatctgagtgtggcttatgtgtgtgggtgctcaagggtgtcttggtgccagcactgggagtgggcaaaaggtgaggctgatcctgggtaagaggtggctaggggacagtttacagggcaactttttggcaaccctaaccatgaacggctgacacctctgcctctcccgtcctgcttgctcaccctcctccaggtttctctcccttcctcctcactccaggcttcccatttctcagagcctgggactcctggcttccactgcctctggggttctggcctctcagccagggattcttgaggatctttctcatacagtctctgactcctttccctctctctctgtctccccgaccccttgccaaagcagctgcctactgggagaagcagcaggcgatcaatagtcactaatcactaatcactaattactaattagctgggggagggcaggggcggggccctgtgggacctgccagctctatcccgcctcaggaaaggattaggtctgattctcttagagctggctggccgaagcccctcagccagctaccccctcctgcctccacaccctcctctagccccccagctaatctctgcctgggccacttaggcacgcacagcctgggctagggcccagagctgctgccggggatttgggggtaatcaggggccgcagctgggccagggggacaggggagggcctgctgtgacagctcccttgggccagagcctgcagtggaagcctcacattcctaataggaggggcatgcgtcagaaaggagaatttagagtgtcagggttgggatgggtagaggagctggagacccaggagcggggtgactggcgaagaggtgaggtaataaggacagaagcaaggcaaagaggggtcagggacgaggtaattggagagagacaacacaaacgtctaaagaaaacaggtaagtggggggacctcacaggggtcagagatggagtaattggcaaggagatggggaactttggacctagccctgcaactcaagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcctggccccctcccacagcctgatcctgcctggtctttgccttgccctctggctcctctcccatacctgtcctcagcccctgtctctgtccccgtctcctgtgtcttcccttgtcccccatttcccattccagtctccctttgagtcttccatccccatctcctgggtctctgcatccatcactgtttctgcccagtaaccatccccatcccccatctctgttttgccccaccctgaccccatccctgcctgtcccctgtgcttatccctcatccaccattcctgtccccatgctgcttcctggactgttctgtagcccatcttcatttctctggtccttaccccatccacatctctgtctctgccccacgcctggccaccatttctattctgcttctcatccctgtccccaggcctatcctcattgtatcctcatccctgtactctatatctgtgcctgccagtccccaatcccagtccccctccctctctgtctcagtcctcaccccaggctgtcctgtccaccccacctctctcctcacccacatctctatccctcgttcccagccagactccaccggcccctattgcagcacccctgcctctttctaggtgcaggggctcaggatgctcttttctccccttccccagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggtgcgtgggcccgctgcctcgggggtaaagccctcctggtgcagctctccccgctccccgaatgggcctgaaggagcctgctgaaccccccagctgccgcgcacctccgccccgcccccgcgccgacagcagcgctagcctctcccctccgcaaatgtcaccgcgcccaattagcttaattaagccagctctggagcaagggggacccctcctcggacaacatcctgctcccaccctcagccatggaggtgggcgacaagagctctgggcagaggagctccttaccacctgccttcccaactcccccacctccccccatgttgctggagacagacaacctgaaggacagcaggagagaaccacagacagagggagaaaatcagaatcatgggaggaggaaatttgagacagagacagtgagaaaagagactgagagacaaaagagactgagagaatggggagggagagatggaaaaacagcacaagagagggagagagagcacgagcaatcaagggagccagagggaggatcttattttattttattccatgttcccatttctcggctctcgtttcctcacagactctcacccctccctgtctgaactcccctacaaggtcgcttcagccgtgcccccccaactcttcctttttatcttggctgtctacagtagtgggtgggggcgggactgcccaaagccaggggattcgccaggatcagagaagcacagacggcactttgtctgagatcagagatgggggtgacaccctggaacctctccttaccctgctgaacctcctcccctccccctgccccttacttctaccccctgcccctgtctggtagaagtcactggcctgaatcaccccagccaggttctgactgggtacaagacataggggtgctctggtctgctgggaggagatggcttggaggcatttggggtcataacatctgatggcatggggataggggggacctggatgactgggcttctggaaagaacagcggttgggtgagattagggaccagagttcaaatggcccacccttcagctttcccaggaaacctaacctccctcccccaatgccctctctcagattcaggccctgccctctccaagcccacttctggggcctcttctccctcccactgtaccctgggacccctccctccaccctctctcaggcccaccctccaggtgttagctgctggcttaagcctgtctgtgggagtcaatcattcttgctgcccccgccccctcacctgggctgagaggagggatggatgggagggggaatgaggggggcgataaatatgtatgacgagcgggtggtggcagcattaataacccgggatcgcagcgtggcggggacggggaccaggcggtggagattctagcccagcagcttggctctgctgttcctgtccccagtgacactgtgtgtgtacacatgggtgtgggcaaacagaggggggcacccatgcttcctggcctccttacctacccacagcacagcctgtgggccagtgtaggacacctccccagagaccactcagatacaattgacatgcatgtatgtcacccccatcggaacacagcaagaccacacttgttctatgactacggatacaccccctttagaaagagcttgacacttgggcagaggatgacaggggctcacacaggaaaggtgacacctccagacaaccacatatagctaccctcagaccgctatacacagccatatagccaacccagacacgtaaccacaccagtcacacagacaccactccacaaattgacacacacacccagccaatccaggcacatacacacagtcaccgatttacacaacagacatgcagccacgacaagcagccacacacacacaggctcctcagactcataaccatgggcatccagatacacacccacacagccaccacagccacacacacatgtaccggccacacacacacaaccatttggggctaacagagacaccagaaccccaggctgacacacatggtactgcctccccccatgggacctgtgcacagtcagggccacagcacgcggcggtggtggctagctcaggctgactgacacactctgacatgcagctcctctcttgcctgctcccctcgctggagcggcatctccatatttcttcctcttgcttcctgtctccttcactcctggccacccccactcacccctaccccagataattgatggcccgggcctggcccggccgctcctgcctctcgatccatcttgtcctcgagcccatgctgtctccaagatcggtggccacctgagacacatagaacgggtgggagcaggagggggctccttagcccccttggagcccaggaaaagaacggccaggcggcctccaccagagtggagcactggcgactgggagggatacccaggctttcctcctctgctcaactggttcccagcactcactccttgcaggccagttggggctgaggcccaggtgggggctctggtctctgaggtcctggagcctctttctttttctttttcttttcctttccttttttcttttcttttcttttttttctgagagggagtctcgctctgtcgcccaggctggagtgcaatggtgcgatctaggcttactgcaacctccacctaccaggttcaagtgattcttccacctcagcctccccaatagctgggactacaggcgcaccccagaacgcccgcctaattttagtagagattaggtttctccatgttggccaggctggtctcgaactgaactcctgacctcaggcaatctgcccacctcagccccccaaagtgctgggattacaggcgtgagtcaccgcgtgtgccgggcgggagcctctttcttgatgctggatgttaatgtggtcacagcctccctggctcagtttgctcagagtccagtccctccctggctcattactggaaccaaccaggtgccgggccaggaaagatgagccaggatccagagctccactccctactcaccttcacactggctttgggtttttggccctcattggagctctgtgggccacatcaggattcttgacgtcatttcacagatgtacaaactgaggcccagatccatgaagtgactgggccaagactacatagcttgaaagggctgcagttctcctccaaggcacgctccctgcccgctgcgggactgcgtgattccatttggtctcctagcggctgtggaaagggactggcgtcgatagggctctggcaggatggcgggggacaaccccagcgtctctctctcctctttcttcgtgcacaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggcccgggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccgtcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccctaccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatccaatacacgcctgtgtgagacctttgtagggaatggggaggtggcgtggggcttctatgtggtagagacctggccaaggccttctccctcagcggctcttggggaaaccaagacaaagactgacagagctagcaccttggaagtcaccaaagaccagatcaaagagagctgagggttaccctcggggtaggagccccgcctgaggttgggattctcctccctgaggtgggcgaagggaagctgcagcaagtgggatggaaatgagacctgagtggggatcaccagcggacgatttggggaaggaggtgtaagaccttgaatgggatggacagggacagtgtaggcagagcgctgacaacctgctaagctccacggggccggcgggaggtggcaggttgggagggagggggaacggtgttcgcggcatctggagtcatcgatcttccttttccttcctaatttcgtgggcgctgagtttgcagacggaggaggtggggagggagctttgggatgagggggtgggggaagggaccagcgcgggtttggagggcggggcccgtggccgctacttgccactagcaaacacagccccctttagccagctgcccaccctcccccaacccctgcctccggctccctcctgcagccgaggctgctaattttatccgcccccgaccctggcctgggcgttaattggctgcggcttcattagcggttctccgctcagccgccccctccccttggggcccctggctggaggagggagggggggcggtgcggacaagctgaggcaccgagaaactcctcatcttcgccttgagtccggggtcagggtgcccactgggagggcagtgttccccaggggcttgcccactggctccagcctgaaactgagtcagacacggggtctgacccagacatatctgggagtgaaaagtcagtaagcagaaaataaatatctgctggctggctggctgaataaccgggtcaactgaaaagaggagggagatcaggaatggttctggatccgagattggccaaaagcagaagaacccggaagtctcctaacaccaggcttattgctggaaacacctgagaagagctgagcctagaatggcagggaaggagcttccggctaaggggagatttctaagggctggtatgagaaccaggtgggaacggctggaattaacaaattcgcccatctgggccttagtttccccacttgtaaagctacagtaaaatagtgtgtggtggggattctatgaggcttttcctgtgaacatgctgctgtgctggatagtcctcccctcttcctctgcctcctcctcttcttcctcatacagctggacatctgagagcagagttaggtgtgtcttcctgtcattgcacttgtcacactttgttacctgttcacctcttggtatcctagcagccagtgagctcttcatgtatctccagggctatggaatgcctggcatagagtaacattgctacataaggcaatgattcgcaaaaccactgcttaacaggctggtccaagtgcagtgatgtttacttgatcataatcagttacattatgataattgatcataatcagttacaggtttctttgtttcttcttcactcccactgcttcacttgactggcctttaaaaaacaatttttttggcctggcgtggtggttcacacctgtaatcccagaactttgggaggccaaggcaggcggatcacctgaggtcaggagttcaagatcagcctgaccaacatggtgaaaccccgtctctactaaaaaatataaaaattagctggacgtggtggtgggcgcctgtaatcccagctactcaggaggctgaggcagggagaattgtttgaacccagaggcagaggttgcagtgagtgaagatcatgccactgcactccagcctgggtgacagaatgagactccgtctcaaaaacaaaaaacaaaaaaaattttttttgaagacagtcttgctctcttgctcaggctggagtgcagtggcttgatcatggctcaccttgaactcccgggctcaagtgaccctcctgcctcaaccttcccagtagctgggactgcatgcacataccaccatgcctaggtaatttaaaatttttccttttgtagagatagggtctcactatgttgaccaggctggtttagaactcctggcctcaagagattctcctgccttggcctcccaaagtgctgggattacaggcatgagccaccatgcccagccaaaaatttttttttaattaaaaaaaaaaacttggcttatcagaatcactgaggagaggtttagttgtgtgacagcataagtgggcaaatgtctactctttgagatccattgaattagaacctctgaagacagaccccacactcatatttatatcatattttctaacccattctgatgctgaggtttgggaacctactcctggaggggttgatgaatcccattcccaagggtttcttccggatgaagtcaggctaaaaggaagatcccttccagtctcaaagatctatagccctggggaaaaaaggagagcccaccgactcctgggacatcaagaggtggacaggtaacaaaatgggacaagtgaacaacaggaggggtgccttcctctgctcccagatgtctgaggagaaagaggagatgccatgtaggaggcaggtctgtgggtcagaggaagaggggaggacaatctgtcacagcgcatgttcacaggaaaagcctcattgaatcctcaccacacagtattttcttgtggctttaccagggaggaaactgaagcccacacaagctaatgcactagtcccagagccggaacttgaattcaggtcttccgacccttctaaaccacggtgctttccagtgttccatagctctttatcttgtgtgggggtctagatctcctggagtctaataatgctagctagatattcagtaggcaccctataaacgtttgtcttgacaacaagcagagagaaaaccctgaaaagcttcaagatagtaaggagagggggcggcactggacctctgtttttgttttttgtttttttccccccaggcaagggcctctaaccctggggctacagacgggaatcataaagaaaaaagcggtgagtgggcgaactacaattcccaaaaggccacaaaggggccaccactacgcatgcgtagatccctcccgttagctttggcgcctcagcgagctcttctcgcgcatgcgttctccgaacggtcttcttccgacagcttgctgccctagaccagagttggtggctggacctcctgcgacttccgagttgcgatgctgtacttctctttgttttgggcggctcgggtaagaatggggctccaaacgctgggtaatcagtggaaaggaagctcttctcctaccttagttcctagtcacaaactctggggttctcttggcttttccatgcacgtggattggggcctcagggagcggacgtgtaactggggaatccccaagacccctgggcgcgcgtggagttaactgcgagcctgtcctcattctggcgatcagacgccccagggcctcgtgaccgcccatttcacgtggcattaggggagaggacagccccggatgccccgcggacccggtgctggcaaatgagcggagttttcggcctggtctcacaagctgagcctttccggccagctctgagccctgcagatgatgcaaccgagcttcactgcttgcatcaggcaggggtcccggcggcagtgagggctggaaggaggtggaacgggtagggggctaagtaaggggaaagggtattggcttactctcgggcagatccccacccccaccactcccacacagctcttcctcacggactgctaaaggtctcccctcccacctgcattgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaaggtggaggtgggggtagtgagaactgaaacaggctggctggacaactggcagcttggtgtggccttagaagcatgagtgagggtggccgggagacgatttgtctggactgttgtgatttcaccctgacttttcctgccttcagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagttatcttaactgatatttctccaaaaccccctttcacactcaggacctttctttgggctttatcttcctttcttatctccctcaagcaaaggcagtgcaagtccagtttatggggttgggacatttagggagcctccagggtccctacagtttcatctgatcccttccttccttcctcctatgaggaaggaggagcctagaagcacaagtttgagtgggtaggtggcattgaggggccactgctcatggcagatgggtttctgagaatgctgcctctggctttgccccaggcctggtgctgagtgaatggagctttctgcagggagtactcccgctttcagctctggctctggcagggagggactgtgggagtccaggggaaggggctcaataccttctgacattgccccccaccaccccagaacttctgcagccgagctgcgctggaggccctggggtcctgtctgaacaacaagtactcggagggttatcctggcaagaggtgagggctggagggcagtgtcagggatggtgctcccagtgggggaacccacctgtaccttcccagtgttcattgaggagtgaacttcccagtcctttgctgatggttgagagtcctttctctgtgccctcattacccctctcccacggcagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccagtgagtatggatgggctggctgatggtcttggcggcaggattggtgtgggaaaggagttatttattgaatacctactgtggaccatacagatggaacaggccttgccctgtcctgcatgtcacagtggatgaggaagataagatcccagttatagtgcctaccacagagtggacagagcagtgaggcggtgtgtcctaggactggtgttctggggacagagaactgtggagttgaagggagtggttaagtccgggggtccttccacccaggccttcttacttcctctcacttcgcagtctcacccacggctacatgtctgacgtcaagcggatatcagccacgtccatcttcttcgagtctatgccctataagctcaacgtgagtgctctagggtgtggggaggggctcttggccctggtggtggtcctcccctggagaagctgagggcctggagcgccgggccgtccttagggttaaggaggagagtgagctgccctgcttccttctcagggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggttggtggggggggctggagactgggcacctccccagggggtggtgaggaggtgtgggaggagggcagccttgggcaggcctctccgggccctccccaggctgaggccttgcctctgtacctgcccaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcaggctccctgaggtcgggccttgcctttccctgccttcaggcctattcctggggcactgttggcctggacctgagaggaattcattcccacctgcagcccttaagactcctgcccagtctgtgagagttctccttctcttgcccatggtggccatgccctggcaggggatttgtggatgggattgaggggctgattccctctaccactggaatccagtgtaccaagcccacgtgagctgtgcccttggggcccaggtccgccagcttcctctgccttctctgtcccttgtccttcttttcagcttagactctgaccatccacctctcacacaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggttggggatcctgtctttgtagggtgtgggggggcaatggcctggaggcttagaccctgcaccttgctaactgatgctggggctgatggaagggaaatgccaggatggaaggagtcaaggctggggtcacagagctatgctgagggtgcagggccagagggtagtgcagggcttgggtccaggcctagggtgacagctgctactgtctcatctccaggcctgcacccccatgttccgggagtactccctgcaggttctgaagaatgctcgggccatggcagatgccctgctagagcgaggctactcactggtatcaggtaagccagcaggtgatgggtgagggcctctgtagcttcaggcagaggcccaggactcaccactccccatttcttacccaccttaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggtgagacctggggtttgaggagggaaggggctcccatgctggatgactgccaggtgaccttgggctatgctcatccctccccttgtgcctcgttccaggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgcccacggctgcttctgtttgatccctggggacagaggggagcaagggaggggagtggcagggggaggcccaggtgtggggctggagggggtactggcggcagcgggaggcagtaggcttgggcaggggaggagtgcgctgcgcctcaggaggcaaaggtgccccagcctgggcaggccctggaccagcccaagctgagcagcgccgcccctgggctggctctcagagcctgggctaacgtggagcccgccacgtcgcttggcactcagaggcccctgcttcttgttggctcacgtaggccacgctcaacacgtagcctgtgccacacccttcgaggcccgggtaggagggcagaggggctggtctgggctcttggtggacccctgctggtgctgcctgcctcctcctcccccacgtgggactcaagccaagggtcagaggcgcttccgctgctgggagcaagggaggagagtaggggtggagcagcctcccctctgcgtgggaacccggcctgtgtaagcagtagcgggacagggtggccggagtgatgccttggggcctgcggggaggagtggaagaagtggatgggctggctggctgtggcttgcatggcactggcagcccagcctggcttagaagtctggccggtccttcttcagcttcttatagtcagtggaaactgcaaggaactaagaggagagggaaagggggttgcgctgagtaccccaagcctccctttgcttctagtacgggagttgtgggtgccaggaccaggagataagaggatggggggcaaccctagagccatcgagaggtaccttgtattggtcattggggctcaggcggttccagggctccgggttgttctttctgtcccagctgtggagcaggaggggggagggttagggtctcctccctgggacccagaactctgtaacccaatttgacccccaagctccacccggaggctctggccccaccccagtacccctgcctcctgccctgggggtcccatttcccagatactgacaaaggaacggtcatattagcaggtgctgacaagtgagacaagaagcctgtcaccattgtcagcatggggctgcgtgacaaactgacaacggggcccagggactcccacttgctgcctgccaccctaggttaaccctaagagcagagtcgtgggaatcagacacagatcccaaggggctgggtttctggtgatgtgccgggaattataaagccatgggtgcgcctttcacttccggaccctctccgcggccgggtgtgaaatctccgccccacactggtccccaatgccacccccagcagctcacccggccacaaccccagtgctctggtgaggacttagaggtacccaaaagcccaagcccaccgctggctgagcggcgtcgtcatggcaacccggccgggagaggcgcgggttccgcatttcagggcgggccaagctgaggagtgagcggccaggtgggctggaggggatacgggggtctcccaggtcagcagtgggctccagccctgagatgccggtcggtacagtcgaaggtgcatgcagcagggcacgggatccccactagggccgcctatttccaccccatcttgcctcacccaggcccccgtgagcatcccaagccgtgcctttaccagacgtcggggctgcgaagggcgagtcgcagcaagtaaagcgcagcgctgcccatgcccaggcagattaagccgatcatcgggatgatctgcggggaagagggagagcacttttggggtcagccctctccccgcagttcccagtcaccctttacaagcttttctgcccaccccaaccccaccccgggtctggtgctccctccctggaatctcctacaaccatatttcctggcatggtctccctcaccctacagcgatcgtgtccaaggtagtagatttgtgggacacagggacgtttcggagagagactggggcaaccttaggggaagaataggagcgctgagggacctgggcacaaggcaaggcattgggggatttggagggtggggcagcaggagagttaggagttagaggttctgaggttctgaggactcacccccggatgtcttttgatctgccggtagaagcgggccccaagactggctcctgccatatcgttgttttcccagtctggtcctctgcagtggctctgtcctctccctcctcctggggtcccgcccctgagtggggagggatcagcccagcccagagcagcttagcttggcccagcccgtgcttctttggactcaccccaccccaacttagctcactttctcctcaattccaggcccaaagcctgtaggggaattgtctgggagccaagtggtttctgctctccgactctctcctccagatgtctgcacctggaccaagggacaccatcattcttggggcttctggcatctgagggaaggacctcagtggcataggaccccataagatgtgggaggaggcatggccatgggacaggcacttagcaaaatgcatgtgtggaatgttcacaggtgggaccaggaggggctaaggccagtgagggcatgtgcagcacttccctgacacccttagagctgtccaggagcgggtcctgagaaccctggttctgtcccctccacagtgtagtgggggaaggaggaagacaggcccacaccgtaaagctcccccagcccctcttgttctgagtggtttcttcaggttgtggttggactggaattgcggttggaggctggaagaaccaggtgtatgttaatcatggctcaggatagaatacgccagtttatttattctaccacagtcatggcagtgaggcttgagagacttgcttgctctgcctacctggggtagggtaaaggtggggccgcccaaggaggccatccacttcctctggctgtgggatggataggaagggaatggagtgggggaaacaggaaagatcggacagatgctgaaagagaacaagacacagacacagaaatgcaagcgattccctcctgtcctcaaccatctcaggtgtgtgctgtgctgctggggtggggaggctcacagcccccgtctctggggaatttgggtcttagggacgtaggaaccgagtcctaatatctctccccactcccacgataacctccaccaccccctccctcctcgcagccgatcctgcagagcacctccccctccagagcccgccctgtggagggcgcgggcgggagcgagctatgcacccgtctctgggatcgtcggggtacagggagggagagggcgctttctagggtccgcctccctttccttctcgctgatacttccgccgccccctactctgacaagcgcggctgtaattaggctgcggggtcccgggctctccgcctcactccggcggataatgagataaagtgtcagagacacggcgagaacaaagagacagagactcgctgcgatgtgtgtggggggggcgggggagcggggctgacgggctgttagagcctccagcagcccagccctcccgagagcccgcgcctccagggcccaggaagggagggcgtgtcctgtcacccgcgcaccccagccctccagtctctgggaccaaaaaacaatcccagagctcaaactcgagcggccgcacaactgggctgcacatctggttctctgtggcacagctggggagccaggacgccggaaggggcgcctggtccttgcgcctttgctcacaggccctcgcctgcttccttgtgccctttgttctgagttccggtgaccccggccaggtcccaaattctccgtcgcgctccttttccagagccgccgctgtccctccggccttgggcctccgccccgctcaccgagatgcaacgttacattattgcctccgctccgcctctccgccactctctgacccttctcctgcttctggtccctgtctctgtgaatttatttctaagcccccttccatctttggttcccgtctctggctcgtggcccatggggccgatctggaatacaggactccttgggttccggatcccatctctcctcgctccccacactttcccaccacgaggactcaggccacgctggcccagcggggtgagggaccgcaggagtcattagccgcagattaggcacggcccgggatcccgctgggactggactccaagcgctaacccgcaccaggatcccaatccgcgcgctggctgcacagagggtcaaaggcagcgggactcagcggatcgagcgtgttgcaggggccgtgggctcgggcgccccctggaggccgagcggcccccaagctcggggaagaggccttgggcaccccctgtcgggcagtgtcgaccctgcactcccggcgttcgggccgctaagttggtgcctggagtgtccgtccacgcccagcccgtcactccgccactcccgcctccaagacagtgggtcctgcagcctccactcttctggtgtgagatgggaccggagggcggagaggggacgcggaagctcctatctctccagccacaatcggcacccagggttcaggcgggttcctcttctggggttgggcatcctcagatgcctgggggccggggaggcgggggcttcatctctgcttctgggctgcagattcgagattgccctaagccctctgacccggcctgtcctagcctctggctgcccttctttctgcctcttgttctttctgccttctgtctgcttcctgtctctgggtatgtccatctctctcttccctattctggctgtgtctgtctgctctccctcttgctgccttccctacctggctttgtccctctgcatcggtttttctgtgtctctttgtgtctcgctccctccctccacatctctccatctcactgtgtctctctttactaatgcctctctttgtctctgtctttatctctgtctctccccaaccccactccccagctctattcctattctctgggttgctgcctctggggactgaagcagcccaacagggcagcccggagacgcctcggggcactgcccggggtcctcatcctggtcacctccacatgcccgtcaactccgcgcagcgttgatcttcccgctgcggctgtgggacgtggaggggcgcccggaaaggaagacacagggcccagcatctgctcgggagccccggggcccctgacccccctctgccattattaagggcgcctggtcccgaggcaccgagatgatcatgattgcatcagccagacagaagcggagccgggagctgcgcggtgagcgaacgagtgagacaaagccgcccgcgccatctgtttatgcaaagcgctctccgccggggaccccggcgtcccggctcctggccgggcttggggcaagggtcataagcccattcccacccggcgcccccaccgcgccttggcttcccctctcctcagcacccagagggccgctgggcgagcggaacggaaagggggcgggggtgttgatgtgattggagcggacgcggctgtttcttcaataatggatggagatgatgcggatggcgaagccgagctggccgggagaggagagaggaatagaaatggggaaaggaaggagtgggggcgggagactcaccccggcgcgcgcacacacacactcgcgcgcgcacgtgcgtcacactgtcattcggatacacgccgccgcgcggctcacacccaggcacacgcctacgcactgtcactgagacacacatacctgcaggcggagacgcgatggcaacacacactccccgctggctcttcctgattttcacacatacacagacctgcaggcggagacgcacggaaacgcccccacgcggaggcacacccgggcaaaatcacccagatgggagctggggacggggaagtggacaaacccgacagatatagacacactcaggggcacagacacacacccgggcacagagtcggacacacctggggctcaggtagacacacctcacatacccagggaacaaacggacacacactaaccacacgccggagatacagacgtccataattgccaggggcacggagagcccacccacacccactcagaggctagcacaccttagcatatgcaggagttgccatctgtgccctgcggggtggaatgtggcagggaggtcgtcagggtctccggagcaggccttgttagcctagcagtatgatgaggtcttggtgacaggaggcgcctggggctgtggactaggaggcccgtgcaccagggcttagctgtctgcaagcttccttgactggcccctagggcgggtagcgccgacgttgggctgcccctgagcagcagaccgggcggaccccactgacccaaatcgggcagtttcgtggagggagagcctaaagggaacactggagctgcaccgagagattctcaggatccccaacactgctgctggtggggtttatagaaagggtcactctgtactctgccttttccccccgtgctgcccagtcttccaacttcaaggggcacgtgtgtgtgtgtgtgcgcgcgcgcgcgcgctgagtagagtgggcagtggaggaggttggggtgccggttgtcttgtaccccagtaccggcccttcctcggatctgttttcaattcagtctgctccttggcccagacttatgacctttgcagcatgcggcagtatcatccatcacccaggcgccgtttagggggatggagggcgctgggagctcacatagggtcgctgtcacgcctgccgccctctctggggacctgctctccggcccgcgggccagggcttaagagtcttggtgagtaatgacgggagggtgtgaccgtggggctcgatcgggacactgggtcacatgtccccacccctggtaccctagcacccctccttctagttcagcacagcctgtttccccgcttttcccgccccccttctctcgggccctttgcttaatttcctattaactgctgataaatccaattaaaccgccgctctaattagggacagctgccggctcagtgaggctagggaggggggcgccccccgagtgttgggggagaacagccgctctccctgcttctcggcatccgcacaccagcattgccgcccaatgagccagtaaattggttttgccttagcattggcgggggtctctcgaggatctcggggggctctgattttgagtccctcagaccttgatgaatagagacgacccgagccctcgcggtccctcccctca

SEQ ID NO: 56 - DNA, 41840 bp, Homo sapiens
ctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaaagaaaaagaaaacaaaagggcagtgcgaggggcaaaggttgagagtggggcagggggcagtcttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaaaaggccaaaaaaaaaaaaaagaaagaaaaaaagccgctggtgtctgcctgtgtgtgagagacgctgggagctggggctgcgctttcctgcttcggccaccagagggagacctgccccgtgctggaggcaggctggcgcgtggtttttagtgcccttctcccagggccctccccctctccatcttactgtgcccgggaagcgggtggcactggacttgacatggaagatctgcttctcctggctgtgtgaccttcagccatgacttcgagtctccagattttgtgttccctctgggtctaggacactaactcagatctgtttctctgcattcacttctaccagacaccacccccctacccaaaatgatcacccacagtgagaagccccactataagaagtgaatacactgaggctgcaaaggttttctcatccttcagggtcctcccatgcggttctctctgcctgagtctgctcttgaagcactgacgtctcactttgtggagactaatgaatcaaatgcgaagtaaaatgctgcattccagagccaggtgtctcctgcggtaaaggagagctgggaagaccagtttgccaggccctctaggcccccagcagctccagctcaccaatcatttcagtcattccagggggtaacaggaaaaaactgtcaatcaaaagtgtccaggtccatttcaacccctgcctagagggggaaacttcttgcagaaagttgcacagtttacactgcccaggactagagagggtttgagtcccagtacagcaaatatgagctcaggaagggtggctgcaaatgtctgaagatcccttacccaactcccaaccaggaagtgctgcctttcattcctcctccctcactggttcaactccaggagattcctcccaggcttccttctgccttggggaagctacaagtctaggcacctgtggaaagaggagccctccccttcccttcttagccttcagaagctctctccaacctcatcctccaagccaactctgagatcctcccctgccttcaaaagggccctggatgggcaactgcggggaaacagaatccgtggttgccgagtaggaggtctgtgtcccaatctggccaccaggtggtgtctgtacgcctggagcaccgcctatcctgaagccccacacagcccccgcctcagcactcattatgcacctgcgggggaccccagcccagtctctcgcttccttctctccggctattttgccacacccctccaccctctgccagccagctcccctccctgccccagcgcctgcctgctcccaccaccaccagccccaaccctgcccctctgccatcggtgcatctggtgccccccgggagccactgatctctgcctgtcacctcaagatcctgggcagagcgacaagggacccccgctgcagcttggaaggcatacccctccagtcagcatcccccactccgcctgtcaggacctgctaggagaaggtccaccaggaggcagtttctcaaactacccacccgggaggcaggtgggaagccctcaccttggcctgagagatgggaagaaccagggacagaggctgagaaccagggacagaagctgataccgaatgagaggcagaaacccagaggcggagagacagggggacagaggcaaagacccagagacagggcgagtagtgtgcatgtgtgtgtttgcacttgtgtttgtgcgagcgcgcacacatgtgtgtgtgtaactggagagagaacaggtggcctgagactgtagctaaaggaggagagatgcagtgggttcggcccccagaagaccaggaccctggtaatgggcttctgtcctggacagcctacgcctaggtgtgcccactgttcccacctactactgaagcagcccccgtgcctggaacgtgggctcagggttctggctcaaggccttttggccttgagcctgaacatttctgccccttcctgcctctctcctctccacccccaccccggcacccaggttcctgcctcctggcttctgcctgtctccctgggtgtctctgaatctgcctcgtcctctcagcaccggtccttttcctgactcgtgtgtgtggctgtcacgtcccatatctatctgtccatttctttgtatgtgcccccacttgtcttctgggctgccagtgacagcatacacctgtgtatgtctcagtgtgtgtgtccacctctgtgggtgtttgctctctgccaagacaaagagagggtgagcgcactgagcaactgtctgggtgtgctcgtctgggtgcaggtgtgctcacctctgttgctgtgctcctctgtgtgttggggtgccgctaggtgtgcgcctgtctctgtatttcgctctgtgtgccctgtccccgtgaaggcatctgcgtgcatccctggggtgggctctcaagggatgtgtctgtctctcagtctctttgcttgtccctatctctgtctaggtgttggtcataccacaacctcagccacagcctcagtgcatagcaacagctgacagctgaaaccacccgggcaggagagagagaggcagtggggaggagggaaccgaggaagaaacagagaagaggatgggggcagagagctggggctggggacagagacaaggacagagatagggaatggggacaaggatctagaagagctggtggtgaaagatgggacggcgggaggggaggaacagagactgcaccaagaggccaggcaggcggcgctgagagggatttcctgcccagcccccatgcagaggcgcactgggcctcgtgggggtcagtggtgggggccaggggcaaaggtgaacagccggtctagccgaggggtcctgagaccgcagaggtgcggtgaggcggggacggggcggagggcgccgtttgtcagccctattgacagacgtgatggggtttccgtccgtgatcaatgattctcatctccgggccgaatgagccgcggggcgcccatccatccccgtcagcatcgcgcggcggcagccgcccgaggccccgcccgtccccacctcggcccctgccctgcgcctgccccgacacaccttggccctgaacagggcagaggcccggggcttggagagcgtcgtccggctgggctccgcggcgcccccactccaggtgcacgggcccggagcccagagccccacgccctgccccgttcctcctgggcgcacagacgcggcctctcgggggaccagtgcctgagcccctcgaccccctccgcttcgcacctgggccaggggcgtgtccggggcgtgccggtgtgaaagtcaccttcggtgcccccagctgggcgggagggggcgcgcggggcgcggccgggattggagcgccgcggagccccgccccccgcccgcggagtcagacccaactttctcccccgcccgcgccccgcccccagcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggtaagagtggcagggctggggcgctagcgcgggcgcggggttccgggacgcgaaggtcccagtgtgcgaggggctccgtgcgcccgccccgcccccagctccgagcgtcccaactttgcgcggcgcgggggaagcggacagacagactgcccgattcaggacgggcactctcctagcgcaagttggctgaggcttggagagggtgccgggcggaggtcccccttgcagccgacttcaggcgcggcgggggaggggacgaagcccgacccgcgagtgcgccagacagagcgggagtgcgagacagacagacaagccagcagggtgtcagccttgccgtctttccgcgccagtctcgctcgcctgcctcactgtctgtctgtccttccacccctccacccccgccttcccatttctcttctctgcacttgtcaccatgccaggtgggctctgtgtcgggagcatccatggcccgagcacacacgcacacacggactcaggcagacacggctgaacttggctacagccagcctcccatcacatttcccacggagacaccatctcccctgcacgacctcacagacacacccccctctcgtgccccactgaagggggaggctgtctggaaggggagtctctcctcccatgccctccctgcctccaaccccactccaaggcctctttccctgaggctctcgggcgaagagccagaggctaagggagctcagacttgatctgcctccttcctgacttggaggcttcaacctgcgaacatgctgtgctcatatgtgctgggtggagggcgtgggtcaccgtgtgcacctgtgtgcatgtgtccagggaagccaggcttggtccagtactggggccgagggtacatgtgtatactggtgtggtgtgtggtgttggctttgcatgagtgagtgtcagtgcctgcctcacagtgcagccatctgcctatgcccctggtgtgtgcccgcaatgggggcccaggccccagtcccccattttccttctaccagcctcccctgcctatggcttccctgttttctgacccccaactgtgacctacctagtttgggggcaggcaggtcattccccaaaccctcattctctgtaccctcagcccctgtagagtctagaaggggtgtatttcttcccccaacacttggacctctgcctgctcagccaaatcacatttggcaaaccccagcagggcaggggctgccccagtgaagctagcattagagctccctggccctcccagccccacctggtgaccttgaggggctgcacggtaggcagaggagcccctccatgaaaactgcttccactagcaggagcttcttagggacttgctgcccaactctgtccttagtgaactggaggagtggggggggtctgtgccctaccacccacccacccatgtgtgaaggcctggggtcaagaggtggtaggtatggcattctcttgcccctcctttccacttcctcccacctcatctccactctcccaggcaaataaactcccctgtggacagatctggtttaatttcctttgccccctgagggggaatgaaacatctggtggagacttgagtgagagtgagcgtgaggatatgagcaatgggatctatctgagtgtgtgtgtgtgagctgcagctgtggggcctccgtgttggagtcaacagggagagtggatctgctggttagcccagcttatgtgcatgtgagaatgtgtttacatgtgtacacactgcgggtgtgtgaatatgtataactgcacggggaggtgtgggtatatgagtgtttgtgtgtccaaatacctgtgtgtgcttctgtgcacttgtgagtgtggcgtatgcacatgtataccccggggtttctggtgcatctgtgtgctggggcccatgtgttgtctgtatgagtctctggggtttgtgagtgtgtttctgtgtgcttgtgattgtgagtgcatttgagtgtgctatgagattgtgagcctcaggatgtgtttatgtatctgagtgtggcttatgtgtgtgggtgctcaagggtgtcttggtgccagcactgggagtgggcaaaaggtgaggctgatcctgggtaagaggtggctaggggacagtttacagggcaactttttggcaaccctaaccatgaacggctgacacctctgcctctcccgtcctgcttgctcaccctcctccaggtttctctcccttcctcctcactccaggcttcccatttctcagagcctgggactcctggcttccactgcctctggggttctggcctctcagccagggattcttgaggatctttctcatacagtctctgactcctttccctctctctctgtctccccgaccccttgccaaagcagctgcctactgggagaagcagcaggcgatcaatagtcactaatcactaatcactaattactaattagctgggggagggcaggggcggggccctgtgggacctgccagctctatcccgcctcaggaaaggattaggtctgattctcttagagctggctggccgaagcccctcagccagctaccccctcctgcctccacaccctcctctagccccccagctaatctctgcctgggccacttaggcacgcacagcctgggctagggcccagagctgctgccggggatttgggggtaatcaggggccgcagctgggccagggggacaggggagggcctgctgtgacagctcccttgggccagagcctgcagtggaagcctcacattcctaataggaggggcatgcgtcagaaaggagaatttagagtgtcagggttgggatgggtagaggagctggagacccaggagcggggtgactggcgaagaggtgaggtaataaggacagaagcaaggcaaagaggggtcagggacgaggtaattggagagagacaacacaaacgtctaaagaaaacaggtaagtggggggacctcacaggggtcagagatggagtaattggcaaggagatggggaactttggacctagccctgcaactcaagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcctggccccctcccacagcctgatcctgcctggtctttgccttgccctctggctcctctcccatacctgtcctcagcccctgtctctgtccccgtctcctgtgtcttcccttgtcccccatttcccattccagtctccctttgagtcttccatccccatctcctgggtctctgcatccatcactgtttctgcccagtaaccatccccatcccccatctctgttttgccccaccctgaccccatccctgcctgtcccctgtgcttatccctcatccaccattcctgtccccatgctgcttcctggactgttctgtagcccatcttcatttctctggtccttaccccatccacatctctgtctctgccccacgcctggccaccatttctattctgcttctcatccctgtccccaggcctatcctcattgtatcctcatccctgtactctatatctgtgcctgccagtccccaatcccagtccccctccctctctgtctcagtcctcaccccaggctgtcctgtccaccccacctctctcctcacccacatctctatccctcgttcccagccagactccaccggcccctattgcagcacccctgcctctttctaggtgcaggggctcaggatgctcttttctccccttccccagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggtgcgtgggcccgctgcctcgggggtaaagccctcctggtgcagctctccccgctccccgaatgggcctgaaggagcctgctgaaccccccagctgccgcgcacctccgccccgcccccgcgccgacagcagcgctagcctctcccctccgcaaatgtcaccgcgcccaattagcttaattaagccagctctggagcaagggggacccctcctcggacaacatcctgctcccaccctcagccatggaggtgggcgacaagagctctgggcagaggagctccttaccacctgccttcccaactcccccacctccccccatgttgctggagacagacaacctgaaggacagcaggagagaaccacagacagagggagaaaatcagaatcatgggaggaggaaatttgagacagagacagtgagaaaagagactgagagacaaaagagactgagagaatggggagggagagatggaaaaacagcacaagagagggagagagagcacgagcaatcaagggagccagagggaggatcttattttattttattccatgttcccatttctcggctctcgtttcctcacagactctcacccctccctgtctgaactcccctacaaggtcgcttcagccgtgcccccccaactcttcctttttatcttggctgtctacagtagtgggtgggggcgggactgcccaaagccaggggattcgccaggatcagagaagcacagacggcactttgtctgagatcagagatgggggtgacaccctggaacctctccttaccctgctgaacctcctcccctccccctgccccttacttctaccccctgcccctgtctggtagaagtcactggcctgaatcaccccagccaggttctgactgggtacaagacataggggtgctctggtctgctgggaggagatggcttggaggcatttggggtcataacatctgatggcatggggataggggggacctggatgactgggcttctggaaagaacagcggttgggtgagattagggaccagagttcaaatggcccacccttcagctttcccaggaaacctaacctccctcccccaatgccctctctcagattcaggccctgccctctccaagcccacttctggggcctcttctccctcccactgtaccctgggacccctccctccaccctctctcaggcccaccctccaggtgttagctgctggcttaagcctgtctgtgggagtcaatcattcttgctgcccccgccccctcacctgggctgagaggagggatggatgggagggggaatgaggggggcgataaatatgtatgacgagcgggtggtggcagcattaataacccgggatcgcagcgtggcggggacggggaccaggcggtggagattctagcccagcagcttggctctgctgttcctgtccccagtgacactgtgtgtgtacacatgggtgtgggcaaacagaggggggcacccatgcttcctggcctccttacctacccacagcacagcctgtgggccagtgtaggacacctccccagagaccactcagatacaattgacatgcatgtatgtcacccccatcggaacacagcaagaccacacttgttctatgactacggatacaccccctttagaaagagcttgacacttgggcagaggatgacaggggctcacacaggaaaggtgacacctccagacaaccacatatagctaccctcagaccgctatacacagccatatagccaacccagacacgtaaccacaccagtcacacagacaccactccacaaattgacacacacacccagccaatccaggcacatacacacagtcaccgatttacacaacagacatgcagccacgacaagcagccacacacacacaggctcctcagactcataaccatgggcatccagatacacacccacacagccaccacagccacacacacatgtaccggccacacacacacaaccatttggggctaacagagacaccagaaccccaggctgacacacatggtactgcctccccccatgggacctgtgcacagtcagggccacagcacgcggcggtggtggctagctcaggctgactgacacactctgacatgcagctcctctcttgcctgctcccctcgctggagcggcatctccatatttcttcctcttgcttcctgtctccttcactcctggccacccccactcacccctaccccagataattgatggcccgggcctggcccggccgctcctgcctctcgatccatcttgtcctcgagcccatgctgtctccaagatcggtggccacctgagacacatagaacgggtgggagcaggagggggctccttagcccccttggagcccaggaaaagaacggccaggcggcctccaccagagtggagcactggcgactgggagggatacccaggctttcctcctctgctcaactggttcccagcactcactccttgcaggccagttggggctgaggcccaggtgggggctctggtctctgaggtcctggagcctctttctttttctttttcttttcctttccttttttcttttcttttcttttttttctgagagggagtctcgctctgtcgcccaggctggagtgcaatggtgcgatctaggcttactgcaacctccacctaccaggttcaagtgattcttccacctcagcctccccaatagctgggactacaggcgcaccccagaacgcccgcctaattttagtagagattaggtttctccatgttggccaggctggtctcgaactgaactcctgacctcaggcaatctgcccacctcagccccccaaagtgctgggattacaggcgtgagtcaccgcgtgtgccgggcgggagcctctttcttgatgctggatgttaatgtggtcacagcctccctggctcagtttgctcagagtccagtccctccctggctcattactggaaccaaccaggtgccgggccaggaaagatgagccaggatccagagctccactccctactcaccttcacactggctttgggtttttggccctcattggagctctgtgggccacatcaggattcttgacgtcatttcacagatgtacaaactgaggcccagatccatgaagtgactgggccaagactacatagcttgaaagggctgcagttctcctccaaggcacgctccctgcccgctgcgggactgcgtgattccatttggtctcctagcggctgtggaaagggactggcgtcgatagggctctggcaggatggcgggggacaaccccagcgtctctctctcctctttcttcgtgcacaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggcccgggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccgtcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccctaccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatccaatacacgcctgtgtgagacctttgtagggaatggggaggtggcgtggggcttctatgtggtagagacctggccaaggccttctccctcagcggctcttggggaaaccaagacaaagactgacagagctagcaccttggaagtcaccaaagaccagatcaaagagagctgagggttaccctcggggtaggagccccgcctgaggttgggattctcctccctgaggtgggcgaagggaagctgcagcaagtgggatggaaatgagacctgagtggggatcaccagcggacgatttggggaaggaggtgtaagaccttgaatgggatggacagggacagtgtaggcagagcgctgacaacctgctaagctccacggggccggcgggaggtggcaggttgggagggagggggaacggtgttcgcggcatctggagtcatcgatcttccttttccttcctaatttcgtgggcgctgagtttgcagacggaggaggtggggagggagctttgggatgagggggtgggggaagggaccagcgcgggtttggagggcggggcccgtggccgctacttgccactagcaaacacagccccctttagccagctgcccaccctcccccaacccctgcctccggctccctcctgcagccgaggctgctaattttatccgcccccgaccctggcctgggcgttaattggctgcggcttcattagcggttctccgctcagccgccccctccccttggggcccctggctggaggagggagggggggcggtgcggacaagctgaggcaccgagaaactcctcatcttcgccttgagtccggggtcagggtgcccactgggagggcagtgttccccaggggcttgcccactggctccagcctgaaactgagtcagacacggggtctgacccagacatatctgggagtgaaaagtcagtaagcagaaaataaatatctgctggctggctggctgaataaccgggtcaactgaaaagaggagggagatcaggaatggttctggatccgagattggccaaaagcagaagaacccggaagtctcctaacaccaggcttattgctggaaacacctgagaagagctgagcctagaatggcagggaaggagcttccggctaaggggagatttctaagggctggtatgagaaccaggtgggaacggctggaattaacaaattcgcccatctgggccttagtttccccacttgtaaagctacagtaaaatagtgtgtggtggggattctatgaggcttttcctgtgaacatgctgctgtgctggatagtcctcccctcttcctctgcctcctcctcttcttcctcatacagctggacatctgagagcagagttaggtgtgtcttcctgtcattgcacttgtcacactttgttacctgttcacctcttggtatcctagcagccagtgagctcttcatgtatctccagggctatggaatgcctggcatagagtaacattgctacataaggcaatgattcgcaaaaccactgcttaacaggctggtccaagtgcagtgatgtttacttgatcataatcagttacattatgataattgatcataatcagttacaggtttctttgtttcttcttcactcccactgcttcacttgactggcctttaaaaaacaatttttttggcctggcgtggtggttcacacctgtaatcccagaactttgggaggccaaggcaggcggatcacctgaggtcaggagttcaagatcagcctgaccaacatggtgaaaccccgtctctactaaaaaatataaaaattagctggacgtggtggtgggcgcctgtaatcccagctactcaggaggctgaggcagggagaattgtttgaacccagaggcagaggttgcagtgagtgaagatcatgccactgcactccagcctgggtgacagaatgagactccgtctcaaaaacaaaaaacaaaaaaaattttttttgaagacagtcttgctctcttgctcaggctggagtgcagtggcttgatcatggctcaccttgaactcccgggctcaagtgaccctcctgcctcaaccttcccagtagctgggactgcatgcacataccaccatgcctaggtaatttaaaatttttccttttgtagagatagggtctcactatgttgaccaggctggtttagaactcctggcctcaagagattctcctgccttggcctcccaaagtgctgggattacaggcatgagccaccatgcccagccaaaaatttttttttaattaaaaaaaaaaacttggcttatcagaatcactgaggagaggtttagttgtgtgacagcataagtgggcaaatgtctactctttgagatccattgaattagaacctctgaagacagaccccacactcatatttatatcatattttctaacccattctgatgctgaggtttgggaacctactcctggaggggttgatgaatcccattcccaagggtttcttccggatgaagtcaggctaaaaggaagatcccttccagtctcaaagatctatagccctggggaaaaaaggagagcccaccgactcctgggacatcaagaggtggacaggtaacaaaatgggacaagtgaacaacaggaggggtgccttcctctgctcccagatgtctgaggagaaagaggagatgccatgtaggaggcaggtctgtgggtcagaggaagaggggaggacaatctgtcacagcgcatgttcacaggaaaagcctcattgaatcctcaccacacagtattttcttgtggctttaccagggaggaaactgaagcccacacaagctaatgcactagtcccagagccggaacttgaattcaggtcttccgacccttctaaaccacggtgctttccagtgttccatagctctttatcttgtgtgggggtctagatctcctggagtctaataatgctagctagatattcagtaggcaccctataaacgtttgtcttgacaacaagcagagagaaaaccctgaaaagcttcaagatagtaaggagagggggcggcactggacctctgtttttgttttttgtttttttccccccaggcaagggcctctaaccctggggctacagacgggaatcataaagaaaaaagcggtgagtgggcgaactacaattcccaaaaggccacaaaggggccaccactacgcatgcgtagatccctcccgttagctttggcgcctcagcgagctcttctcgcgcatgcgttctccgaacggtcttcttccgacagcttgctgccctagaccagagttggtggctggacctcctgcgacttccgagttgcgatgctgtacttctctttgttttgggcggctcgggtaagaatggggctccaaacgctgggtaatcagtggaaaggaagctcttctcctaccttagttcctagtcacaaactctggggttctcttggcttttccatgcacgtggattggggcctcagggagcggacgtgtaactggggaatccccaagacccctgggcgcgcgtggagttaactgcgagcctgtcctcattctggcgatcagacgccccagggcctcgtgaccgcccatttcacgtggcattaggggagaggacagccccggatgccccgcggacccggtgctggcaaatgagcggagttttcggcctggtctcacaagctgagcctttccggccagctctgagccctgcagatgatgcaaccgagcttcactgcttgcatcaggcaggggtcccggcggcagtgagggctggaaggaggtggaacgggtagggggctaagtaaggggaaagggtattggcttactctcgggcagatccccacccccaccactcccacacagctcttcctcacggactgctaaaggtctcccctcccacctgcattgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaaggtggaggtgggggtagtgagaactgaaacaggctggctggacaactggcagcttggtgtggccttagaagcatgagtgagggtggccgggagacgatttgtctggactgttgtgatttcaccctgacttttcctgccttcagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagttatcttaactgatatttctccaaaaccccctttcacactcaggacctttctttgggctttatcttcctttcttatctccctcaagcaaaggcagtgcaagtccagtttatggggttgggacatttagggagcctccagggtccctacagtttcatctgatcccttccttccttcctcctatgaggaaggaggagcctagaagcacaagtttgagtgggtaggtggcattgaggggccactgctcatggcagatgggtttctgagaatgctgcctctggctttgccccaggcctggtgctgagtgaatggagctttctgcagggagtactcccgctttcagctctggctctggcagggagggactgtgggagtccaggggaaggggctcaataccttctgacattgccccccaccaccccagaacttctgcagccgagctgcgctggaggccctggggtcctgtctgaacaacaagtactcggagggttatcctggcaagaggtgagggctggagggcagtgtcagggatggtgctcccagtgggggaacccacctgtaccttcccagtgttcattgaggagtgaacttcccagtcctttgctgatggttgagagtcctttctctgtgccctcattacccctctcccacggcagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccagtgagtatggatgggctggctgatggtcttggcggcaggattggtgtgggaaaggagttatttattgaatacctactgtggaccatacagatggaacaggccttgccctgtcctgcatgtcacagtggatgaggaagataagatcccagttatagtgcctaccacagagtggacagagcagtgaggcggtgtgtcctaggactggtgttctggggacagagaactgtggagttgaagggagtggttaagtccgggggtccttccacccaggccttcttacttcctctcacttcgcagtctcacccacggctacatgtctgacgtcaagcggatatcagccacgtccatcttcttcgagtctatgccctataagctcaacgtgagtgctctagggtgtggggaggggctcttggccctggtggtggtcctcccctggagaagctgagggcctggagcgccgggccgtccttagggttaaggaggagagtgagctgccctgcttccttctcagggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggttggtggggggggctggagactgggcacctccccagggggtggtgaggaggtgtgggaggagggcagccttgggcaggcctctccgggccctccccaggctgaggccttgcctctgtacctgcccaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcaggctccctgaggtcgggccttgcctttccctgccttcaggcctattcctggggcactgttggcctggacctgagaggaattcattcccacctgcagcccttaagactcctgcccagtctgtgagagttctccttctcttgcccatggtggccatgccctggcaggggatttgtggatgggattgaggggctgattccctctaccactggaatccagtgtaccaagcccacgtgagctgtgcccttggggcccaggtccgccagcttcctctgccttctctgtcccttgtccttcttttcagcttagactctgaccatccacctctcacacaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggttggggatcctgtctttgtagggtgtgggggggcaatggcctggaggcttagaccctgcaccttgctaactgatgctggggctgatggaagggaaatgccaggatggaaggagtcaaggctggggtcacagagctatgctgagggtgcagggccagagggtagtgcagggcttgggtccaggcctagggtgacagctgctactgtctcatctccaggcctgcacccccatgttccgggagtactccctgcaggttctgaagaatgctcgggccatggcagatgccctgctagagcgaggctactcactggtatcaggtaagccagcaggtgatgggtgagggcctctgtagcttcaggcagaggcccaggactcaccactccccatttcttacccaccttaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggtgagacctggggtttgaggagggaaggggctcccatgctggatgactgccaggtgaccttgggctatgctcatccctccccttgtgcctcgttccaggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgcccacggctgcttctgtttgatccctggggacagaggggagcaagggaggggagtggcagggggaggcccaggtgtggggctggagggggtactggcggcagcgggaggcagtaggcttgggcaggggaggagtgcgctgcgcctcaggaggcaaaggtgccccagcctgggcaggccctggaccagcccaagctgagcagcgccgcccctgggctggctctcagagcctgggctaacgtggagcccgccacgtcgcttggcactcagaggcccctgcttcttgttggctcacgtaggccacgctcaacacgtagcctgtgccacacccttcgaggcccgggtaggagggcagaggggctggtctgggctcttggtggacccctgctggtgctgcctgcctcctcctcccccacgtgggactcaagccaagggtcagaggcgcttccgctgctgggagcaagggaggagagtaggggtggagcagcctcccctctgcgtgggaacccggcctgtgtaagcagtagcgggacagggtggccggagtgatgccttggggcctgcggggaggagtggaagaagtggatgggctggctggctgtggcttgcatggcactggcagcccagcctggcttagaagtctggccggtccttcttcagcttcttatagtcagtggaaactgcaaggaactaagaggagagggaaagggggttgcgctgagtaccccaagcctccctttgcttctagtacgggagttgtgggtgccaggaccaggagataagaggatggggggcaaccctagagccatcgagaggtaccttgtattggtcattggggctcaggcggttccagggctccgggttgttctttctgtcccagctgtggagcaggaggggggagggttagggtctcctccctgggacccagaactctgtaacccaatttgacccccaagctccacccggaggctctggccccaccccagtacccctgcctcctgccctgggggtcccatttcccagatactgacaaaggaacggtcatattagcaggtgctgacaagtgagacaagaagcctgtcaccattgtcagcatggggctgcgtgacaaactgacaacggggcccagggactcccacttgctgcctgccaccctaggttaaccctaagagcagagtcgtgggaatcagacacagatcccaaggggctgggtttctggtgatgtgccgggaattataaagccatgggtgcgcctttcacttccggaccctctccgcggccgggtgtgaaatctccgccccacactggtccccaatgccacccccagcagctcacccggccacaaccccagtgctctggtgaggacttagaggtacccaaaagcccaagcccaccgctggctgagcggcgtcgtcatggcaacccggccgggagaggcgcgggttccgcatttcagggcgggccaagctgaggagtgagcggccaggtgggctggaggggatacgggggtctcccaggtcagcagtgggctccagccctgagatgccggtcggtacagtcgaaggtgcatgcagcagggcacgggatccccactagggccgcctatttccaccccatcttgcctcacccaggcccccgtgagcatcccaagccgtgcctttaccagacgtcggggctgcgaagggcgagtcgcagcaagtaaagcgcagcgctgcccatgcccaggcagattaagccgatcatcgggatgatctgcggggaagagggagagcacttttggggtcagccctctccccgcagttcccagtcaccctttacaagcttttctgcccaccccaaccccaccccgggtctggtgctccctccctggaatctcctacaaccatatttcctggcatggtctccctcaccctacagcgatcgtgtccaaggtagtagatttgtgggacacagggacgtttcggagagagactggggcaaccttaggggaagaataggagcgctgagggacctgggcacaaggcaaggcattgggggatttggagggtggggcagcaggagagttaggagttagaggttctgaggttctgaggactcacccccggatgtcttttgatctgccggtagaagcgggccccaagactggctcctgccatatcgttgttttcccagtctggtcctctgcagtggctctgtcctctccctcctcctggggtcccgcccctgagtggggagggatcagcccagcccagagcagcttagcttggcccagcccgtgcttctttggactcaccccaccccaacttagctcactttctcctcaattccaggcccaaagcctgtaggggaattgtctgggagccaagtggtttctgctctccgactctctcctccagatgtctgcacctggaccaagggacaccatcattcttggggcttctggcatctgagggaaggacctcagtggcataggaccccataagatgtgggaggaggcatggccatgggacaggcacttagcaaaatgcatgtgtggaatgttcacaggtgggaccaggaggggctaaggccagtgagggcatgtgcagcacttccctgacacccttagagctgtccaggagcgggtcctgagaaccctggttctgtcccctccacagtgtagtgggggaaggaggaagacaggcccacaccgtaaagctcccccagcccctcttgttctgagtggtttcttcaggttgtggttggactggaattgcggttggaggctggaagaaccaggtgtatgttaatcatggctcaggatagaatacgccagtttatttattctaccacagtcatggcagtgaggcttgagagacttgcttgctctgcctacctggggtagggtaaaggtggggccgcccaaggaggccatccacttcctctggctgtgggatggataggaagggaatggagtgggggaaacaggaaagatcggacagatgctgaaagagaacaagacacagacacagaaatgcaagcgattccctcctgtcctcaaccatctcaggtgtgtgctgtgctgctggggtggggaggctcacagcccccgtctctggggaatttgggtcttagggacgtaggaaccgagtcctaatatctctccccactcccacgataacctccaccaccccctccctcctcgcagccgatcctgcagagcacctccccctccagagcccgccctgtggagggcgcgggcgggagcgagctatgcacccgtctctgggatcgtcggggtacagggagggagagggcgctttctagggtccgcctccctttccttctcgctgatacttccgccgccccctactctgacaagcgcggctgtaattaggctgcggggtcccgggctctccgcctcactccggcggataatgagataaagtgtcagagacacggcgagaacaaagagacagagactcgctgcgatgtgtgtggggggggcgggggagcggggctgacgggctgttagagcctccagcagcccagccctcccgagagcccgcgcctccagggcccaggaagggagggcgtgtcctgtcacccgcgcaccccagccctccagtctctgggaccaaaaaacaatcccagagctcaaactcgagcggccgcacaactgggctgcacatctggttctctgtggcacagctggggagccaggacgccggaaggggcgcctggtccttgcgcctttgctcacaggccctcgcctgcttccttgtgccctttgttctgagttccggtgaccccggccaggtcccaaattctccgtcgcgctccttttccagagccgccgctgtccctccggccttgggcctccgccccgctcaccgagatgcaacgttacattattgcctccgctccgcctctccgccactctctgacccttctcctgcttctggtccctgtctctgtgaatttatttctaagcccccttccatctttggttcccgtctctggctcgtggcccatggggccgatctggaatacaggactccttgggttccggatcccatctctcctcgctccccacactttcccaccacgaggactcaggccacgctggcccagcggggtgagggaccgcaggagtcattagccgcagattaggcacggcccgggatcccgctgggactggactccaagcgctaacccgcaccaggatcccaatccgcgcgctggctgcacagagggtcaaaggcagcgggactcagcggatcgagcgtgttgcaggggccgtgggctcgggcgccccctggaggccgagcggcccccaagctcggggaagaggccttgggcaccccctgtcgggcagtgtcgaccctgcactcccggcgttcgggccgctaagttggtgcctggagtgtccgtccacgcccagcccgtcactccgccactcccgcctccaagacagtgggtcctgcagcctccactcttctggtgtgagatgggaccggagggcggagaggggacgcggaagctcctatctctccagccacaatcggcacccagggttcaggcgggttcctcttctggggttgggcatcctcagatgcctgggggccggggaggcgggggcttcatctctgcttctgggctgcagattcgagattgccctaagccctctgacccggcctgtcctagcctctggctgcccttctttctgcctcttgttctttctgccttctgtctgcttcctgtctctgggtatgtccatctctctcttccctattctggctgtgtctgtctgctctccctcttgctgccttccctacctggctttgtccctctgcatcggtttttctgtgtctctttgtgtctcgctccctccctccacatctctccatctcactgtgtctctctttactaatgcctctctttgtctctgtctttatctctgtctctccccaaccccactccccagctctattcctattctctgggttgctgcctctggggactgaagcagcccaacagggcagcccggagacgcctcggggcactgcccggggtcctcatcctggtcacctccacatgcccgtcaactccgcgcagcgttgatcttcccgctgcggctgtgggacgtggaggggcgcccggaaaggaagacacagggcccagcatctgctcgggagccccggggcccctgacccccctctgccattattaagggcgcctggtcccgaggcaccgagatgatcatgattgcatcagccagacagaagcggagccgggagctgcgcggtgagcgaacgagtgagacaaagccgcccgcgccatctgtttatgcaaagcgctctccgccggggaccccggcgtcccggctcctggccgggcttggggcaagggtcataagcccattcccacccggcgcccccaccgcgccttggcttcccctctcctcagcacccagagggccgctgggcgagcggaacggaaagggggcgggggtgttgatgtgattggagcggacgcggctgtttcttcaataatggatggagatgatgcggatggcgaagccgagctggccgggagaggagagaggaatagaaatggggaaaggaaggagtgggggcgggagactcaccccggcgcgcgcacacacacactcgcgcgcgcacgtgcgtcacactgtcattcggatacacgccgccgcgcggctcacacccaggcacacgcctacgcactgtcactgagacacacatacctgcaggcggagacgcgatggcaacacacactccccgctggctcttcctgattttcacacatacacagacctgcaggcggagacgcacggaaacgcccccacgcggaggcacacccgggcaaaatcacccagatgggagctggggacggggaagtggacaaacccgacagatatagacacactcaggggcacagacacacacccgggcacagagtcggacacacctggggctcaggtagacacacctcacatacccagggaacaaacggacacacactaaccacacgccggagatacagacgtccataattgccaggggcacggagagcccacccacacccactcagaggctagcacaccttagcatatgcaggagttgccatctgtgccctgcggggtggaatgtggcagggaggtcgtcagggtctccggagcaggccttgttagcctagcagtatgatgaggtcttggtgacaggaggcgcctggggctgtggactaggaggcccgtgcaccagggcttagctgtctgcaagcttccttgactggcccctagggcgggtagcgccgacgttgggctgcccctgagcagcagaccgggcggaccccactgacccaaatcgggcagtttcgtggagggagagcctaaagggaacactggagctgcaccgagagattctcaggatccccaacactgctgctggtggggtttatagaaagggtcactctgtactctgccttttccccccgtgctgcccagtcttccaacttcaaggggcacgtgtgtgtgtgtgtgcgcgcgcgcgcgcgctgagtagagtgggcagtggaggaggttggggtgccggttgtcttgtaccccagtaccggcccttcctcggatctgttttcaattcagtctgctccttggcccagacttatgacctttgcagcatgcggcagtatcatccatcacccaggcgccgtttagggggatggagggcgctgggagctcacatagggtcgctgtcacgcctgccgccctctctggggacctgctctccggcccgcgggccagggcttaagagtcttggtgagtaatgacgggagggtgtgaccgtggggctcgatcgggacactgggtcacatgtccccacccctggtaccctagcacccctccttctagttcagcacagcctgtttccccgcttttcccgccccccttctctcgggccctttgcttaatttcctattaactgctgataaatccaattaaaccgccgctctaattagggacagctgccggctcagtgaggctagggaggggggcgccccccgagtgttgggggagaacagccgctctccctgcttctcggcatccgcacaccagcattgccgcccaatgagccagtaaattggttttgccttagcattggcgggggtctctcgaggatctcggggggctctgattttgagtccctcagaccttgatgaatagagacgacccgagccctcgcggtccctcccctca

SEQ ID NO: 57 - DNA, 1781 bp, Homo sapiens
tttttgcaatttggcattatggaactcaactttaaatgcctaacctctaactcagccattctatttctaagaattaattctgcgcagtcccccgttttgggaacatttcccacgcctgttctccattctcctgtagaaggggaacagggagcgggaaggaggggaacagggaaggggagggaggggaacagggaggggggacaggagggaggagaacaggcagtgggggcgggaggggagcgggggggaaggcatgggagggggcggaagggagggggcagggagggagagaggtgatgggaaggggaaaaggagggaggaggacggagagaggggaaaggagggaggggagcagagaagaagcggggcggggaaggggcggggaaggggcgtggaagggagtggggcaaggaatcaacactgagccccgtggcccgctcccgggtcagcgcgcctctctgctctcaccggggcgggtccgctgttggccccacccactcccagcccacccggccccgcaatggcccggcccagccgcccacccccccgacaggccccgccccattccccgccccccgtctgttcgtcacgcccggctctgccgctccgtcccgcaggccccgccctcatcccgcctcccggcccggcgcgcagtgcggctgcgcgggcgtctcaggctctgaggcccgggcgccgcggctcttttgtttctccgttggggccgagcccgggccctagttggagccggagtcggagtcggagtcggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgaggtgaggcccccgtccggcccgggatcccccgcccaggatcccctgcccctgcatccccgccccgagattccccgcctgtcccgggacccccccacgcctcccgagagccccactcgactttccaggccgacccccaccccaggatccccaccccgcgacccccagcccgactttccagttcagactcccgccccgagatccgctgccgggctttccagcccagatcctcactccgagacccccagcccgactttcctgtccaaaccctcaccccgggacaccccgcaacctggtcccacagccggctttcgaggctggatccctaccccaggacccccagcgcgatcctcaacctggctccccactcggccttccagtcccgggattcccaaccgggatcatctcagggccccacctgtgtggactggggtctgggggaggcctgcgaggggcagccctggccttgaaggtgcacgtttggctttcagaagcacgatttggaggtcgccgtcaagtgcattaacaagaagaacctcgccaagtctcagacgctgctggggaaggaaatcaaaatcctgaaggtgagccagtgctgggggagggggcgtgggcgtgggcgtgggcaagcccccctcccc

SEQ ID NO: 58 - DNA, 13995 bp, Homo sapiens
ttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggctcactaagacagtctaccctgtagttccgtttgcacccaagatctttgggaagccaaagaaggggtgggtcgttggtgaaatgtaaggggtggggacgaagtatatggctgaacccttggggcaggccagaatgatttttcctggtgctggtctgccctgcaaacagaccaaagagactaattttcgtatcaaccagagatctctgcaatagggaaaagaacactgtatttcctggtcaatccaccaggatcccaggtgcctcctcctggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttccttccctgttatctttgggatcagcaactggccagggttgggaagaggagggaagaggaggctgtactccagggccacctgccctgccaggtctctgtactcttgtctgctggatagatattgaacacttcccaggatataaagcagtttcacctcttttagcagttctgattggtggaaggtgccgggaaccatgcgttcacaaggatttggggagctcagcaggcataagtcctgtgattgattagtgatgccggtcacaggcatggaatttgaagtagagacacgtgtactggttatttgtcatcttccaattttcttttttcttctttttttttttttttttttttttttgagacggagtctcactctgttgcccatgctggagtgcagtggcgggatcttacctcactgcaacctccgcctgctgggttcaagaaattctcctgcctcagcctttggagtagcgtggattacaggcacatgccagcatgcctgggtaacttttatatttttagtagagatggggtttcaccctgttggccaggctgttattgaagtcctgaccttgtgatccgcccacctcggcctcccaaagtgctgggattacaggcatgagccactgtgcccggccatcttcaaattttctatgagccatttttttttttttttttgagatggaatctcactttgtcacccaggctggagtgcagtggcatgatctcggctcactgcaacatccacttccctggtttaagcgattctcctgcctcagcctcctgagcagctgggattacaggtgcccaccaccacaccagctaattttttttgtatttttagtacagacagtgtttcacaatgttggacaggtaggtcttgaactcctgacctcaagtgatccacctgcctcggcctcccaaagtattgggattacaggcgtgagcactgctcctggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcgggtctggcgggcaccagtgcgatggtgcgctgtacttgcggcacaggtagtaaaggatggccgcgctgcagaaggggccggtcaggggcactgcccttgccttcctgagtgccactacatcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacggagggtagcccctggaggtgcagggaggttatggacttaatgcttaagattaggcattatataagccagggcatgaaaggatccatctctctggtgctggatggagggtgagcccgagggggcagaatggacaatgagggggccagcaactatcgggaaggttgtggtgtctgggaatgttggaggccatggggacagagggaaggggatggaggggagacatgcttcggaggggatgtcctaggccttgctgattgatggctggtgtgggaacctccgcagcacaagggctcctttatcatcaccagcagcaaccatgccaaggtaaaaaggtcagggcatggagagagctatcggttaaaaagtggcaggagagacagcaactggctgcaagactcagaacttcttggctgggcacggtggctcacgcctgtaatcccagcactctgggaggccgaggcggggggatcatggggtcaggagatcgagaccatcctggttaacacagtgaaaccccgtctctactaaaaatacaaaaaaattagccaggcatggtggcgggcacctgtagtcccagctactcaggaggctgaggcaggagaatggcgtgaacccgggaggcggagcttgcagtgagccaagatagcgccactgcactccagcctgggcaacagagcgagactccgtctcaaaaaaaaaaaaaaaaaaaaacttctttggatcctgatccaaacaaactgccaagaaaatgtttaggagataatcatagagttttgaacaggagccacatattagatgaaatccaggaattattgttaattttatgaggtatcttaatggtatcgtagtgatgctacgctctatcctagcccaggctggagtgcagtggcgcaatcagagttcactgcagttctgaacttcctggcctcaagcgatcctcccgtgtcagcctctggaagtgctcggattataggcatgagccaccacacccagcctgttgctttttttttgtttgttttaagaactcttatctctgaaaagtatgttcctaaacatttattgatttatttacttatttatttttatttttgagatgggatctcactctgttgcccacgctgaagtgcaacgacgcagtcttggctcactgcatcctctgcctcctggctcaagcagtctttccgcctcagcctcccgagtagctgggactacaggtgcagaccaccatgctggctaatttttgtattttttgtagagatggggttttgccatgttgtctaggctaggctggtcttgaacacgtgagctcaggccatcccctcacttcagcctctcaaagtgctagaattacaggcatgagctggcttctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgcttgcactgaacctcccaggagaagcagagacagatggtgcaagggccccagggaagacttacctttcacttaagataaatttcccatctttgaggctgggcagcttcctgagggggttgatgtcaatgtatcctttgctgtggtggtgacctgggaggggcagggaaggtctgaggctgtgggactccaggggagagagaactgagactcccagagacccaaacgcctccctctctattttctcaagaagagggaactgaggcccggagggacattgcgtctcaccccaggtcacagggcaaggcagttgcagaaccggactgcgatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagcttttggagtccctctgtgctggggatggagttggagcccacccctctgaccctcactcagggttagtggagccctgagcctttctgaacactggggaggatgggtgtagacggactgtgcacttctgccccctttgccaacctggtgggcaggtgctgagttcacaaggtcctagaatcccacaaggaagccagggtgcctggtgggagcccagggagtcccagctactgttccttcccccttctcctcgaaaagcctgttcatctgtggcgtggggactgtcattagtgagcactgactaaggtaggctggacaaggatgcagcctacaagccgcgtggcatcttttccttccctgtggacctctggggtgattcccttgtctctgtctctgctcctcagaaacgcccctatcaggctgtgcgcggtggctcacgcctgtaatcccagcactctggaggctgaggtgggcagatcacttgaggtcaggagtttgagaccagcctggccaacatggtgaaacccctgttaaaaatacaaaaaattagctgggcgtggtggcatgcacctctaatcccagctactcgggaggctgaggcaggagacgcacttgaacccagcagaggttgcagtgagccgagatagcaccaccgtactccatgctgggcaacagagcgagactccatcaaaaaacaagaaaaaaagaaaagccgcaatctgtgtgtcctgcctccccccaggaccaggcctgccaggcagcagtgggagttgacctttcagcagatccacaaactgaaagttgaactggatgtcatgcttcttcgagaagatgtagacggcacggcagggtgctgacagcaggtccatgtagagctccagtgccatgttgagacacatgccaggccccacagccgcagttggccagccacagacctgggcctatgtctggccagagtccctggccctgtgccctctccgatctgggcccaggatcctgtgttccccagggaaacctcttgtttccctttgtgttgtcataaggccaggaagcctgcaattctcacagcatcaaggattctaaggaggcccaggagtaggctggggagaggcccgtggcaaaggtgtggcagccgtgaccctactctcccccttccacgtgtgcctgtgccccgtggtgccacctcacagacaccagtctgagaagggattatgcctgggaattcccacggctggattttcattgcagaacctgacgaaaggggctttgcagggtccagaatgaagaggaggcaatgagaattatccctggaggattctagaagtagaggctgggagtatccacaggtaaatcgagcctgaactatgactagaaaggaattgggagaaagagacacaggtgaatcgagcctgaactatgactagaaaggaactgggagaaagagacacaggaaactgtgagctttgggagcaatggggacaccaccaccaggaagtcagggggcactcagccggtgtgtgccacacagaggagcctagaaacttcctggccttggttggggctgcagtggccagactgtgtacctggtggccaaggaaggtaactagagccccacgtagaggactgagtgccactcactctatgctgtgatctaataggtctaggctgagaaatgggactgaccccacttctggtgacagagtaagcctggagacaagcgaagagcatgcagtgtgtttattgcagacagcagggtgcagtggagtgggctgcacccactgcacctgcttctgggccagctgggggtcccgccaagcctcactgtggttcagaggctggagtatgagcttgtgggcctccagcaagagctcagtaccaagggcagccgccacacgggcctgccacactgccagccggggcagtcttggaagaggtcgcagccaacggcagtgggctgggaagacagggcagctggggttggggctcagccccatgcccagagtccccccagagggcaggtgggtaggaaagcttcacctgcatcacctccgtcagcaccaagtcttccagggagatctgctccattgccaggaagggcctggccaccagcaccccccaatccaggtgctgcagggctggcatcagcctccccaacagccgctccagctgtgcagcatctgcaggctgtccggagaagtggggcaggagagactgggctgggaggagaggagcaacttaacccagactcttggaagcctcttgggcctcctctccatcccttcccggctgccactcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtgccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatccgggtgacctacgtcctttccccacctgggcagctccagctggctcagactctagccaggttccagcctccagctttagcccaaaggtgcccctgggtccagcctctgcatcggagctacacaggctgaaatgaggaaggggcctcagtgatttggaaagatctccaagccaaggaaagatctcccctctcgcctctgcctccccctacaactctgagccccagaacccaggcagatcctggctctgaccctgggtgggcaccaggtcaccattacctctttgctagtaggaagtcgccatctctgagggcaggcaccttccccagggggttcaccttcaggaactcaggcttcaggtgctcccttggtgggcagaaaggcgagaaggctcagtgtagggcctggtccttggcacccactccatggggcccagcccagccacctggctcaccccaagccaactccaccatccacagctcaaaagggatgtcattctgtcttgcaaaagtggatagtgtgtcaggtccaggaagagctcaagccccattgctgctcctctcacctgccctccccagaattctggacctccaggagttgctcagcccttctccactagttctgagctgtttcctgtccatagtctgctgtagtgggccagagcacagggcagatttgtcttcagggactttctctgggcattcctgggcagagaacttcatcttctctgttaactcttgctgataattctctgtagctaggcaccttgtaaaacccatgtcccagaatgccaaacctggaaatgcaatgtcagcgccgaaactgcattgaaactgaatgaa

SEQ ID NO: 59 - DNA, 1581 bp, Homo sapiens
actctcctaatcttgcttccattgttatctgagacggcttcatacctttttttggataatatgttatattatccaaagcaaggtatgaagccggaaatagactctgttagtggaatgagctgcaaagtcacattgctgtgggcagggatacagagaagaatggacacttatggctacttttaccacctacccacagacgcgtgatctgaggtcgtaaacactggactgtgagagattgcacttgaggcaatggggtgtgcctcaactagacgtctagctcacatcccatcctacctccaccctgaggctggggccgcatcttaccatgtgtctttttattgcaggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggtgagctggggtctgttgtgctctatgggcagagtgctccgggctaagaagggattggctgggacctgcagtgtaatcacgttgcatttaaaatgcaaatgatgttccttgtctcagggttgttgcaggagtaagaaccaagcaggtgagtataaaactcttaccacagtaagtggtgaacagtgaatgtccaacaaatggaaacacttgtgaagtggcctcattgtctggggtaacacccgaggttcattgtcccagggccgtggagatccaaggacgcagagatccaaggacgcagatacacaaagagtgaggttaagagcagaagtttaataggcaaaagaaagaagagctgtctgctacagagaggggtctcggaaaaatggattgcccgatccatggtgaaatgcagagggttttatagacgagctggtgggaggtgtggtgtctgatctacatagggcatgaaaaactggttaggaccaggtgtgccgtttgcatagggtgtgaatttctggcagcccccaccccagtcttttattaagcaggcaggttctctgcctgagctgcactatgttgcccatttctttcttactgtacccatgctaataaaaaagggaagatggtgcttccatggtgaacaggcctggcccccaggtagctcttttcactggcgcagctgctggcattccccccatgcaatcttcgcgctcccttatttatgtttgcagctcagtttttcaggatgctctttgttagaaaagaaatgatttcttgggctggtttttgttagaagggaagctctgctgaggacttttgccctcactatctgcctaaataattttttacctcctatatcacttattattataatacaaattatgatacatgtttatattttaaatatttatgtgtaaatacaagttatatgtatattcataagtataacatttataaatagaaacttatataaacataatttatattttaatttgttatatttataattacatataatcccacaaacattattttactagataactatagagtccttaacattttt

SEQ ID NO: 60 - DNA, 4308 bp, Homo sapiens
ctaagtagtaatgacgtgcagattctctttgcattaggattgcagattctagttggaaaataggttgcatccaagagatgcaactgacaaactttggggagagaagtgatgaagagctcgccattccatttgtggagactttgcattttctgggggtggtatcccacctatggttccctgggtttatgaggtggggcaggctcactgcttcctgattactggatcccagcagaagcagcatgctgctgaagtccaggtcactgggggccattgttatatatatttcacttctccaggccctctacctgactttagaagtgcccacccacatatattcagtttctggaggggtttgatcttaaaactggatccgaagtgatacagtctgagatattgaaaacatagaaattggccgggcgtggtggctcacgcctgtaatcccagcactttggaaggccaaggcgggcagatcatgaggtcaggagatcgagaccatcctggctaacactgtgaaacccatctctactaaaaatacaaaaaaaattagccaggcacggtggcgggcatctgtagtcccagctactcaggaggctgaggcaggagaatagcgagaacccgggaggaagaggttgcagtaagccgagatcgcgccactgcactccagcctgggcaactagaacgaggctccgtctcaaaaaaaaaaaaaaaaaaagaaaacatagaaattaaggatttccagatttccaaacactttaaaaatgaggccaggcatgatggctcatgcctgtaatcctagcacattgggaggccgaggtgggaggattccttgagcaccagaattcaaaaccagcccgggaaagatgacaagacctcatctctacagaaaacagttacctggccatggtaatacatgcctgtagagccagctactcaggaggctgaggtgggagaaccgatcaagcctggaagaccgaagccgcagtgagccgtaatcaccccactgcactccaggctgggggacagagcaagaccctgtctcaaaaaaagaaagaaagaagaaaaagaaaatcgcctaccgtaggtgttttaggttacagtttggattctctaatgcctgacagagaatccacaatccacgagctatctggttgatactcaagtccaggtttgtgaggctgcaggcttcttggagcgcctctgagagatatctacagccaagcttggttatgctgcattgctgtaacctacaggataatcaaaggaagagaagcctgttatccctctggctaacgccctgtgaagcagttatttccaacactatataccttccacttatatactggaatgcagtgctgcactcttggctcactgcaacctctgcctcccaggttcaagcgattcttctgcctcagcctcccaagtagctgggattataggtgcccgccacctatataaccagacttggtggtgcacgcctgtagtgccagctactcagaagactgaggcaggagaatcgcttgaatccgggaggcagaggctgcagtgagctgagatcgcgccactgcactccagcccgggcgacagagcgagactccgtctcaagaaaacaacaacaacaacaaaaagtatttatataaaacataggtggcaggtaggaattgacccatgaactggagctatatacttccaggtgggcttgcacataaaagcatgcaaatgggccgggcacagtggctcacgcctataatcacagcagtgggaggccaagacgggcagatcatttgaggtcaggagttcaagaccagcctggccaacatggtgaaaccccatctctactaaaaaatacaaaaatcgggccgggcgcggtggctcaaacctgtaatctcagcactttgggagaccaaggtgggtgaatcacaagatcaggagttcaagaccagcctggccaaagtggtgaaaccccatctttactaaatacaaaaattagctgggcacgatggctcacacctgtaatctcagcactttgggaggctgaggcagacagatcacctgaggtcgggagttcaagaccagcctaagcaatatggagaaacccgtctctactaaaaatacaaaattagccaggtgtggtggcacatgcctgtaatcccagctactcaggaggctgaggcaggagaatctcttgaactggggagacggaggttgtggtgagcagagattgcaccattgcactccagcctgggcaagagcgaaactccatctcaaaaaaaaaaaaaaattagccaggtgtggcggcccatgcctgtaatcctagctactcaggaggctgaggtaggagaattacttgaacccaggaagcggaggttgcagtgagccaagatcgcaccactgcactccagcctggtgacagagagagactgttaaaaaaaaaaaaaaaacatccaaatggccttctgattccatccatttccagctctgcctgggacaacagcttaggctctgggttcagaccgacccaggacaggatctgagccctgggtcacttattttctgcgtggttagattatggaaatttcactttccctgtcattttatttcatgtttaagttttgtctttaactgacacattctacatatataggggtatagtgtgatgttttggtgcaggtacacttcgtataacgatcaggtaggtgactgtttgtttaacaatagttattctaagccaggcacagtggctcatgcctggaacgccagcactttgggaggccgaggcaggcagatcacttaaggccaggagttcaagaccagcctggccaacatggtgaaacctcatctccactaaaagtgcaaaaattagccaggcatggtggagggcacctgtaatcccagctacttgggaggctgaggcaggagaatcgcttgaacctgggaggcagaagttgcagtcagccaagattacaccactgcattccagtctgggcgacagagtgagacttcatccaaaaaaaaaaaaatgaatctcagaaatgaccactagctagaatttctgaacaggaacaggtcttcaaccctatgcaatctcttgaatatttttctaaccataattttaatgtgaacaggtagctcacgctgggcttctttccatataacaagattcagccaactatagttcgtgggtcaattccaacctgccacctatgtcttttacaaataaggatttttgttgagtttttttttgtttttttcttgagacggagtctcactctgtcgcccgggctggagtgcagtggcgccatctcagctcactgcagcctctgcctcccagattcaagcgattctcctacctcagccttctgagtagctggtactataggcacgcaccaccaagcctggttaatttttgtattttttagtagcgatgggttttcaccatgttggccaggctggtctcgaaccttaggtgatctgcccaccattcaccacctgttccccaataacctatggaaataaaagtttaaaaaaaggtgccactggccctaccacataactcaatctacctccaatagcaggcagtactatgtcataggaatttgaaagaacacacacaaagcatcagatccgagaaccaactactcatctcaaatcttccttcatagcaggaagaggctctgctgacatgcaaatattaacatgtttctacctgtatctgcctggttttttttgtttctttgtttttttgagaaggagtcttgttctgtcgcccaggctggagtgcagtggtgcgatctcggctcactgcaacctccgccttccaggttcacgccattctcctgtctcatcctcccaagtagctgggactacaggcatccgccaccacacctggctaatttttggtatttttagtacagacagggtttcaccatgttaaccaggatggtctccatctcctgacctcatgatccacccgcctcggcctcccaaagtgctgggattacaggcatgagccaccacgcctggcctctgcctgttctttaattcttaccaggtttttaaaagttacatttgaaatgaattaacaagtactttcatgtctctcctgcttgaattcatgtgcacacacacacacacccagcagggacttacaccaaggtctgcagtttacaatcagggtaactcaagccctcacacagaaacttcacccctgtatccccaatggggttcttggccaagcacaggtgtgtcagcttcttgctgacaaccaagacagcagcaaggtccttgcaactggcttctgtaagacgacag

SEQ ID NO: 61 - DNA, 2543 bp, Homo sapiens
gaagtaatgcgcgacaagaatttaaactcttaaaacgattagcagcaaaggtctcatgtgcttttttttaattatcattttttaatcgaggtataatttatgcatttaaaaaatcagatcaattgccccccgggctctgggatggaaggcggtgtgcgcctgcgaaggtcagaggcccagcggcgccagggctcctcggcggagagccgcccgggtccggcgctttgctttcgccttctgccccaccgcgggcgaagccccagggccccggggagactccaggccggctgggccggggtgcgcccgccggctgtccgcgctcgggcagggtggggcgcagcgggcgtctgtcctgctagcggggatcgggcggctggacccaagagcagggcacgtgcgcagcgacgcggggcggccccgccaggagccccgacccgggcgcggcgcagggcccggcggagagcgcgcattcccgagcgccgcgagccggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaaggtgaggcgggcgcccctcccacccgacggccgcgggcccctgcgctgggcagccagactcggggcggcgggggcgagggagcagcgggccgggggtccgccgggcgccgccgagacccgagcctccctgcccgggcgcggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaataaaagaagatggtgaggcctccgaggcctctgagctggggctgaggagggccgagagacccgggtccgggagcgcgacccgatggaggacacccccaggctgtctggcgtgcgcgtctgtcgtgggccggtgctggggcactttagaggcacaggccaggccgagagccattgccttaactttccccacctttggcttctcttgatttttgcttttacccatagcccccaactccagctgacaccgcacttagagaatttcctcatccgttttactttaagaagtagcaattatctttctcaaagaattttaatcaagcggagaaagttgcagggcactatgtgtggccttcagatttgggtctcttggcacttaattcccaatgtcggctgagcctctgatcacaagacatttaaattaactgttttcagaaggctctgtaatcaacaaagacacgtcgctgtaaactaaacgctggaaattattcttaatgtagttttatttgtaatatcagcttcagagtgaaaattccaacacgaattctgggaagagtgaaaatggtacccgaattttgtaagaccctaaccccaggtgcttggctgctgctactgatggttaagtggggaggttgtttgttttcttttggttgta

SEQ ID NO: 62 - DNA, 12390 bp, Homo sapiens
acacagttgtaacttagaatatgcttataatatttttaaaaatgttatagcatccttttaaagagtttatgaataatttgtgctggttttcaaggggaatgcttccagcttttgctcattcagtatgatattggctgtgggtttgtcacaaataggtcttattattttgagatatgtctcatcaatacctagtttattgagaatttttagcatgaagagatgttgaattttatcgaaagacttttctgcatctattgagataatcatgtggtttttctcactggttctgtttatgtgatggattacatttattgatttgcatatgttgaacgggccttgcatcccagggatgaagccaacttgatcatggtggataagctttttgatgtgctgctggattcggtttgccagtcttttattgaggattttgcattgatgttcctcagtgataatgacctgaaattttctttttttgttgtgtctctgccagattttggtatcaggatgatgctggcctcataaaatgagttacggaggattccctcttttctatcatttggaatagtttcagaaggaatggtaccagatcctctttgtacctctagtagaattcggctatgaatccctctggtccttttcttggttgctaggctattaattattgcctcaatttcagagcctgttattggtctattcaggaattcaacttcttcctggtttagtcttgggagggtgtatgtgtccaggaatttatccatttcttctagattttctagtttatttgcgtagaggtgtttataacactctctgacggtagtttggatttctgtgggatcagtgctgatctcccttttatcattttttattgtgtctatttgattcttctctcttttcttctttattagtcaggctagtggtctatctattttgttgatcttttccaaaacaccagctcctggattcattgattttttttgaagggttttttgtgtctcttgtcgccttcagttctgctctgatcttagttatttcttgtcttctgctagcttttgaatttgtttgccattgcttctctagttcttctaattgtgatgttagggtgtcgattttagatctttcccccttcctcctgtgggcatttggtgaaacactgctttagctgtgtcccagagattctggtatattgtgtctttgttctctttggtttcaaagaactaatttatttctgccttaattgtgttatttacccagtagtcattcaggagcaggttgttcagtttccatgtagttgtgcggtttgtagttagtttctcaatgctgacttctaatttgattccactgtggtctgaggggctgtttgttatgatttccattcttttgagtttgctgaggagtgttttacttccaattatgtggtcaattttagaataagtgcgatgtggtgctgagaagaatgtatattctgttgatttggggtggagagttctgtagatgtctattaggtccgcttggtccagagctgagttcaactcttgaatatccctttttttttttctgaatatcctttttaattttcagtctcgttgatctaatattgacagtgaggtgttaaagtctcccactgttattgtgtggaaatctaagtctctttgtaggtctctaagaacttgctttacgaatctgggtgctcctgtattgggtgcatatatatttaggacagttagctcttcttgctgcattgatccctttatcattatgtaatgccttgtttttttttttatctttgttggtttaaaatctgttttatcagtgatgaaaattgcaactcctgcttttttttttctttccatttgcttggtaaatcatcctccatccctttatttcaaacttatgtgtgtcttgcatgtgagatgggtctcctgaatacagcacactgataggtcttgcctctttatccaatttgccagtctgtgtcttttaattggggcatttagcctgtttacatttaagattaatattgttatgtgtgaattgatcctgtcattacgatgttagctggttattttgcccattagttgacgcagtttcttcatagcatcaatggtctttataatttggtatgcttttgtagtggttggtactggttgttcctttccatatttagtgctttcttcaggagctcttgtaaggcaggcctggtggtgacaaaatctctcagcatttgcttgtctgtaaaggattttctccttcgcttttgaagcttagtttggctagatatgaaattctgggttgaaaattattttctttattaatgaatataggcccccactctcttctggcttgcagggtgtctgagagagatccgctggtaagactaacagggatgggcttccctttgtgggtaacccgacctctctggctgcccttaatatattttccttcatttcagccttggtaaatctgacgattacatgtcttggggttgctcttctcggggagcatgtttgtggtgatctctgtatttcctgaattggaatgctggcctgtcttgataggttggggaagttctcctaggtaatatcctgaagagttttttccaatttggtccattctccctgtcactttcaggtacatcaatcaaacgtaggttcactcttttcacatagtcccatatttcttggaggctttgctcattcccttttgttttttttttttctctaatcttgtcttcttgctttatttcattaagttgatcttcaatctctgatatcctttcttctgattcatcgattcggctattgatactcatgtatgtgtcacgaagttctggtgctgtttttttcagctccatcaggtcatttatgttcttctctaaactggttattgtagttagcaattcctctaccctttatccaaggttattagcttccttgcattgagttagaacatgctcctttagcttggaggagtttgttattacctaccttctgaagcctacttctgtcaattcaccaaactcattctctatccagttttgttcccttgctgtcaaggagttgtgatcctttggaggaaaagaggcattctggtttttggaactttccgcatttttgcactgggttttcctcatcttcatggatttatctacctttggtctttgatgttggtgacctttggatggggtctctgagtggaagtcctttttgttggtgttgatgctattcctgtttgttagttttccttctaacagtcaggcccctctgctgctggtctgctggagttggctggaggtccactccagaccctgtttgcctgggtatcaccagcggaggctgcagaacagcaaagattgctgcctgttccttactctggaagcttcgtcccagaggggcattgccagatgccagcagagctctcctatatgaggtgtctgtcaacccctgctgggaggtgtctcccagtcaggaggcacggggttcagggaccaacttaaggaggtagtctgtcccttagcagagcttgagtgctgtgctgggagatccactgctctcttcagagccggcaggcaagaatatttaagtttgctgaagctgtgcccacagctgccccttccccaaggtcaaaaatttaaaattttaagtgactacttgaaaaataaaatatctaaatgatcagatccttattatcttcctctaagtcatctttggagatatctaacatctgtgatctgtgtaatgatttttaattctagcttataaatgacaagccaagacctttgccagtattttctttcaacttgatatttttgtcagacctctggaattatacatcatgtatctgatttaaagatttaattatcatagtttattcacctatcataattaatcatgcttagttaaaaagtctcatttcacagctacaaaaagcaaatactcatattcaaatttcactgtgcagaaacaagctaatcttttattagaaatatggctcccttccaaaaaggaaacagctttaattactaagaaactatgaagcaaatcatttggaccaacaatgactttgtttcaatgttctctcacataagccttactttattctttaaaagatgaatttagtcattagtagtacaacagggatacctgtttatgtaattaataaactaagcagatagtcccaagattaaatgttaccctgctacaatttttaacaaaagtgacggattctttcctaatatttgcctgccatttaacataaagtcataaagattttctgctcgagatgttttatgaagcacaaaacgacctcctttttaaaccaaagcaagattggctaatcaaattttttataactgcgaaacattacataacagggactgtgctttttatgtatcctttagctaacaaactgttactaaattttattacctcaaagacaactgaacacagaatggactactgcctttttgcctacacttcttacctaaaactaagcccttttgttctccaatacattaacagttcatttcaatttctggtatttgaaacgtaggtgtgatctaaagtctttgcacgtaattttaaaacaaaagcacttctgatagtttctaaacataaatgaggcaacacttcacttcttctttagttaccgctgtggcaggtcctcacctattcctgatttcaaagagtaaaactcattttctagaggagactgactctgtaaaaggttgataaatagagtatttataaatcacatgacaaaaaatgctataaactaggtacttataggttcaattatatattttttttaatttttaaacttttaggttcacgggtaacgtgaatgtttgttacacaagtaaactcatgagaacaaagttacaacacatcagaatctctgggacacagctaaggcagtgttaagagggaaattcgtagcactaaatgcctccatcaaaaagttagaaagatctcaaattaacaacttaacatcacaactgaaagaattagagcagcaataacaaatcaaccccaaactagcagaagacaagaaataaccaaaatcagagctgaactgaaggaaatcaagatatgaaaaaccattcgaaaggtcactagatccaggagttgtttttttgaaaaacttaatgagatagataggccactagctagactaactgaattatattttaaatgcactagaggagctgactttctaagaaatattatcattaactctttaatatacctgttttttaaaattcatacatttctaatagacagcagaaaataactaattagtatactgacagttgaaccttttttaatatttataattaaaaaatgaagtttattttatttttttaatatacttaaagttctagagtacatgtgcacaacgtacaggtttgttacatatgtatacatgtgccatgttggtgtgctgcacctgttaacttgtcatttatattaggtatatctcctgatgctatccctccaccctcctcctaccccatgacaggccctggtgtgtgatgttccctaccctgtttccaagtttttcattgttcaattcccacttatgagcacgaacatgcagtgttcggttatctgtccttgcgatagtttgctgagaacgatggtttccagcttcatccatgtccctacaaaggacatgaactcatcctattttatggctgcatagtattacatggtgtatatgtgccaaattttcttcacccagtctattgctgatggacatttgggctagttccatgaatatagcagcatgatttataatcctttgggtatatacccagtaatggaatggctgggtaaaatggtatttctagttctagatccttaaggaatcaccacactgtctgccacaatggttgaactagtttacagttccaccaacagtgtaaaaatgttcctatttctccacatcctctccagcacctgttgtttcctgacattttaatgttgccattctgactggtgtgagatggtttctcattgtcgttttgatttgcatttctccgatgatgagcattctttcatgtgtctgttggctgcataaatgtcttcttttgagaagtgtctgctcatatccttcgcccactttttgatggagttgtttttttcttgcaaaatttctttaagttctttatagattctggatattagccctttgtcagatgcgtagattgcaaaaattttctcccattctgtaggttgcctgttcactctgatggtagtttcttttgctatgcagaagctctttagtttaattagatcccatttgtctattttggcttttgttgccattgcttttggtattttagtcatgaagtccttgcccatgcctatgtcctgaatggtattgcctaggttttcttcttgggtttttatggttttaggtctaacatttaagtctttaatccatcttgaattaatttttgtgtaaggtgtaaggaagggatccagtttcagctttctacatatggctagccagttttcccagtaccatttactaaatacggaatgctttccccatttcttctttttgtcaggtttgtcaaagatcagatggttgtagatgtgtggtattatttctgagggctctgttctgttccattggtctatatctctgttttggtaccagtaccatgctgttttggttactgtagccttgtagtacagtttgaagtcaggtagcgtgatgcctccagctttgttctttggcttaggattgtcttggcaatgcaggctcttttttatttccatttgaactttaaagtagttttttccaattctgtgaagaaagtcattggtagcttgatgaaggtggcattgaatctataaattaccttggccagtatggccattttcatgatattgattcttcctatccacaagcatggaatgttcttccatttgtttgtgtcctcttttatttccttgagcagtggtttgcagttctccttgaagacgtccttcacatcccttgtaagttggattcctaggtattttattctctttgaagcaattgtgaatgggagttcactcatgatttagctgtttgtctgttattggtgtataggaatgcttgtgacttctgcacattgattttttgtatcctgcgactttgctgaagttgcttatcagcttaaggagattttgggctgagacgatggggttttctaaatatacaatcatgtcatctgcaaacagggacaatttgacttcctcttttcctaactgaataccctttctttctttctcctgcctgattaccctggccagaacttccaacactgttgaataggagtggtgagagagggcatccctgtcttgtgccagttttcaaagggaatgcttccagtttttgcccattcagtatgatattggctgtgggtctgtcataaatagctcttattattgcgagatacgtcccatcaatacctaatttactgagagtttttagcatgaagggctgttgaattttgtcaatggccttttctgcatctattgagataatcatgtggtttttgtctttggttctgtttatatgatgggttacgtttattgatctgtgcatgttgaaccagccttgcatcccagggatgaagcccacttgatcatggtggataagctttttcatgtgctgctggattcagtttgccagtattttattgaggatttttgcactgatgttcatcagggatatggtctaaaattctctttttttgttgtctctctgccaggctttggtatcaggatgatgctggcctcataaaatgagttagggaggattccctctttttctattgactggaatagtttcagaaggaatggtactagctcctcttcgtacctctggtagaattcagctgtgaatccatctggtcctggactttttttggttggtaggctaataattattgcctcaatttcagagcctgttattgatctattcagaaattgaacttcttcctggtttagtcttcggagggtgtatgtgtccagaaatttatccatttcttctagattttctagtttatttgcatagaggagtttatagtattgtctgatagtagtttgtatttctgtgggatcggtgttgatatcccctttatcattttttattgcatctatttgattcttctctcttttcttctttattagtcttgctagtggtgtatctattttgttgatcttttcaaaaaaccagctcctggattcaccaattttttttaagggtttttgtgtctgtacctccttcatttctgctctgttcttagttatttcttgccttctgctagcttttgaatgtgtttactcttgcttttctacttcttttaactgtgatgttagggtgtcaattttagatctttcctgctttctcctgtgggcatttagtgctataaatttccctttacacactgctttaaatgtgtcccagaaattctggtatattgtgtctttgttctcactggtttcaaagagcatctttatttctgccttcatttcgttacgtacccagtagtcattcaggagcaggttgttcagtttccatgtagttgagctgttctgagtgagtttcttaatcctgagttccagtttgattgcactgtggtttgagacacagtttatcataacttctgttctttttcatttgctgaggagtgctttaattccaactatgtggtcaattttggaataagtgtgatgtggtgctgagaagaatgtacattctgttgatttggggtggagagttctgtagatgcctattaggtccacttggtgcagagctgagttcaagtcctggatatccttgttaactttctgtctcactgatctgtctaatgttgacagtggggtgttaaagtctcccattattattgtgtggagtccaagtctctttgtaggtctctaaggacttgctttatgaatctgggtgctcctgtactgggtgcatatatatttaggatagttagctcttcttcttgaactgatccctttaccattatgtaatggccttgtctctttagatctttgttggtttaaagtctgttttatcggagagaggattgcaacccctgcctttttttgttttccatttgcttggttgatcttcctccatccctttattttgagcctatgtatgtctctgcacgtgagatgagtctcctgaatatagcacactgatgggtcttgactctttatccaacttcccagtctgtatcttttaattggagcatttagaccatttacatttaaggttaatattgttatgtgtgaattcaatcctgtcatcatgatgttagctggttattttgctcgttagttgatacagtttcttcctagcatcaatggtctttacaagttggcatgtttttgcagtggctggtaccgcttgttcctttccatgtttagtgattccttcaggagctcttgtaaggcaggcctgatggtgacaaatctctcagcatttgcttgtctgtaaaagattttatttctccttcacttatgaaacttagtttggcaggatatgaaattctgggttgaaaattcttttctttaagaatgttgagcctggctgccccgtctgggaagtgaggagcgcctctgcccgggcgccccgtctgggaagtgaggagcgcctctgcccagctgtccagtctgggaagtggggagcgcctctgcccaggcgccccgtctgggaagtgaggagcgcctctgcccagctgtcccgtctgggaagtgaggagcgcctctgcccggctgccccgtctgggatgtgaggagcgcctctgcccagccgccaccccgtctgggaagtgaggatcgcctctgcctggccgcctcgtctgggaagtgaggagcgcctctgcctggccgctgtgcaatcttccaagcatgaagtgacagcctgtctgcaggggtacccaacagctctgaagagacagcgaccatcgagaacgggccatgatgactatggcagttttgtcaaaaagaaaagggggaaatgtggggaaaagaaagagagatcagattgttactgtgtctgtgtagaaagaagtagacatagcagactccattttgttctgtactaagaaaaatttttctgccttgggatgctgttaatctataaccttacccccaaccacgtgctctctgaaacatgtgctgtgtcaactcagggttaaatggattaagggcggtgcaagatgtgctttgttaaacagatgcttgaaggcagcatgctggtcaagagtcaccaccactccctaatctcaagtacccagggacacagacactgcggaaggccacagggacctctgcctaggaaaaccagagacctttgttcaagtgtttatctgctgaccttctctccactattatcctatgaccctgccacatccccctctccgagaaacacccaagaatgatcaataaatacttcaaaaaaaaaaaaaaaagcaaatcataaaaaaaaaagaatgttgaatattggcccccactctcttctggcttatagagtttctgccgagagatccgctgttagtctgacgggcttccctttgcgtgtaacgggacctttctctctggctgcccttaatattttttctgtcatttcaactttggtgaatccgacaattatgtgccttggagttgctcttctcaaggagtatctttgtggcgttctctgtatttcctgaatttgaatgttggcctgccttgctaggttggggaagttctcctggataatatcctgaagagcgttttccaacttggttccattctccccgtcactttcaggtacaacaatcaaatgtagatttggtcttttcacatagtcccgtatttcttggaggctttgtttgtttctttttattcttttttctctaaacttctcttctcgcttcatttcattcatttgatcttcaatcactgataccctttcttccacttgatcaaatcagctactgaagcttgtgcatatgtcatgtagttcttgtgccatgattttcagctccatcaggtcatttaaggtcttctctatactgtttattctagttagccattcgtctaatctttcttcaaggtttttagcttctttgtgatgggttcgaacatcctcctttagcttggagaagtttgttattaccaatcttctgaagccttcttctctcaactcgtcaaagtcattctccgtccagctttgttccgttgctgacaaggagctgtgttcctctgcaggagaagaggtgctctgatttttagaattttcagcttttctgctctgttttttccccatctttgtggttttatctatctttggtctttgatgatggtgacgtacagatggggttttggtgtggatgtcctttctgtttgttagttttccttctaacagtcaggaccctcagctgcaggtctgctggagtttgctggaggtccactccagaccctgtttgcctgggtatcaccagcggaggctgcagaagagcaaatgttacagaacagcaaatgttgctgcctgatccttcctctggaagcttcgtctcaagaggggcacccggctgtatgaggtgtcagttggcccctactgggaagtgtctcccagttaggctactcgggggttggggacccacttgaggaggctgtctgtctgttctcagatctcaaactctgtaacgggagaaccagtactctcttcaaagctgtcagacagggacgtttaagtctacagaggtttctgctgccttttgttcagctatgccctgcccccagaagtggagtctacagaggcaggcaggcctccttcagctgtggtgggttccacccagttcgagcttcccggccgctttgattacctactcaagcctcagcaatggcggacacccctcccccagcctcgctgccaccttgcagttcgatctcagactgctgtgctagcagtgagcgaggctctataggcgtgggaccctccaagccaggcgtgggatataatctcctagtgtattgtttgctaagaccattggaaaagcacagtattagggtggaagtgtcccaattttccaggtaccatgtgtcacggcttcccttggcttggaaaaggaattccctgacctcttacgcttcctgggtgaggcgatgccccgccctgcttctgctcacagtccgtgggctgcacccactgtccgacaagccccagtgagatgaacccggtacctcagctggaaatgcaaaaatcacccgtcttctgcgtcgctcatgctgggagctgtagactagagctgttcctatttggccatcttggaacctctccgaaatttattttattaaagggactccagtgaaattcatattaaattttacagta

SEQ ID NO: 63 - DNA, 4028 bp, Homo sapiens
acacagttgtaacttagaatatgcttataatatttttaaaaatgttatagcatccttttaaagagtttatgaataatttgtgctggttttcaaggggaatgcttccagcttttgctcattcagtatgatattggctgtgggtttgtcacaaataggtcttattattttgagatatgtctcatcaatacctagtttattgagaatttttagcatgaagagatgttgaattttatcgaaagacttttctgcatctattgagataatcatgtggtttttctcactggttctgtttatgtgatggattacatttattgatttgcatatgttgaacgggccttgcatcccagggatgaagccaacttgatcatggtggataagctttttgatgtgctgctggattcggtttgccagtcttttattgaggattttgcattgatgttcctcagtgataatgacctgaaattttctttttttgttgtgtctctgccagattttggtatcaggatgatgctggcctcataaaatgagttacggaggattccctcttttctatcatttggaatagtttcagaaggaatggtaccagatcctctttgtacctctagtagaattcggctatgaatccctctggtccttttcttggttgctaggctattaattattgcctcaatttcagagcctgttattggtctattcaggaattcaacttcttcctggtttagtcttgggagggtgtatgtgtccaggaatttatccatttcttctagattttctagtttatttgcgtagaggtgtttataacactctctgacggtagtttggatttctgtgggatcagtgctgatctcccttttatcattttttattgtgtctatttgattcttctctcttttcttctttattagtcaggctagtggtctatctattttgttgatcttttccaaaacaccagctcctggattcattgattttttttgaagggttttttgtgtctcttgtcgccttcagttctgctctgatcttagttatttcttgtcttctgctagcttttgaatttgtttgccattgcttctctagttcttctaattgtgatgttagggtgtcgattttagatctttcccccttcctcctgtgggcatttggtgaaacactgctttagctgtgtcccagagattctggtatattgtgtctttgttctctttggtttcaaagaactaatttatttctgccttaattgtgttatttacccagtagtcattcaggagcaggttgttcagtttccatgtagttgtgcggtttgtagttagtttctcaatgctgacttctaatttgattccactgtggtctgaggggctgtttgttatgatttccattcttttgagtttgctgaggagtgttttacttccaattatgtggtcaattttagaataagtgcgatgtggtgctgagaagaatgtatattctgttgatttggggtggagagttctgtagatgtctattaggtccgcttggtccagagctgagttcaactcttgaatatccctttttttttttctgaatatcctttttaattttcagtctcgttgatctaatattgacagtgaggtgttaaagtctcccactgttattgtgtggaaatctaagtctctttgtaggtctctaagaacttgctttacgaatctgggtgctcctgtattgggtgcatatatatttaggacagttagctcttcttgctgcattgatccctttatcattatgtaatgccttgtttttttttttatctttgttggtttaaaatctgttttatcagtgatgaaaattgcaactcctgcttttttttttctttccatttgcttggtaaatcatcctccatccctttatttcaaacttatgtgtgtcttgcatgtgagatgggtctcctgaatacagcacactgataggtcttgcctctttatccaatttgccagtctgtgtcttttaattggggcatttagcctgtttacatttaagattaatattgttatgtgtgaattgatcctgtcattacgatgttagctggttattttgcccattagttgacgcagtttcttcatagcatcaatggtctttataatttggtatgcttttgtagtggttggtactggttgttcctttccatatttagtgctttcttcaggagctcttgtaaggcaggcctggtggtgacaaaatctctcagcatttgcttgtctgtaaaggattttctccttcgcttttgaagcttagtttggctagatatgaaattctgggttgaaaattattttctttattaatgaatataggcccccactctcttctggcttgcagggtgtctgagagagatccgctggtaagactaacagggatgggcttccctttgtgggtaacccgacctctctggctgcccttaatatattttccttcatttcagccttggtaaatctgacgattacatgtcttggggttgctcttctcggggagcatgtttgtggtgatctctgtatttcctgaattggaatgctggcctgtcttgataggttggggaagttctcctaggtaatatcctgaagagttttttccaatttggtccattctccctgtcactttcaggtacatcaatcaaacgtaggttcactcttttcacatagtcccatatttcttggaggctttgctcattcccttttgttttttttttttctctaatcttgtcttcttgctttatttcattaagttgatcttcaatctctgatatcctttcttctgattcatcgattcggctattgatactcatgtatgtgtcacgaagttctggtgctgtttttttcagctccatcaggtcatttatgttcttctctaaactggttattgtagttagcaattcctctaccctttatccaaggttattagcttccttgcattgagttagaacatgctcctttagcttggaggagtttgttattacctaccttctgaagcctacttctgtcaattcaccaaactcattctctatccagttttgttcccttgctgtcaaggagttgtgatcctttggaggaaaagaggcattctggtttttggaactttccgcatttttgcactgggttttcctcatcttcatggatttatctacctttggtctttgatgttggtgacctttggatggggtctctgagtggaagtcctttttgttggtgttgatgctattcctgtttgttagttttccttctaacagtcaggcccctctgctgctggtctgctggagttggctggaggtccactccagaccctgtttgcctgggtatcaccagcggaggctgcagaacagcaaagattgctgcctgttccttactctggaagcttcgtcccagaggggcattgccagatgccagcagagctctcctatatgaggtgtctgtcaacccctgctgggaggtgtctcccagtcaggaggcacggggttcagggaccaacttaaggaggtagtctgtcccttagcagagcttgagtgctgtgctgggagatccactgctctcttcagagccggcaggcaagaatatttaagtttgctgaagctgtgcccacagctgccccttccccaaggtcaaaaatttaaaattttaagtgactacttgaaaaataaaatatctaaatgatcagatccttattatcttcctctaagtcatctttggagatatctaacatctgtgatctgtgtaatgatttttaattctagcttataaatgacaagccaagacctttgccagtattttctttcaacttgatatttttgtcagacctctggaattatacatcatgtatctgatttaaagatttaattatcatagtttattcacctatcataattaatcatgcttagttaaaaagtctcatttcacagctacaaaaagcaaatactcatattcaaatttcactgtgcagaaacaagctaatcttttattagaaatatggctcccttccaaaaaggaaacagctttaattactaagaaact

SEQ ID NO: 64 - DNA, 21986 bp, Homo sapiens
tcattaactctttaatatacctgttttttaaaattcatacatttctaatagacagcagaaaataactaattagtatactgacagttgaaccttttttaatatttataattaaaaaatgaagtttattttatttttttaatatacttaaagttctagagtacatgtgcacaacgtacaggtttgttacatatgtatacatgtgccatgttggtgtgctgcacctgttaacttgtcatttatattaggtatatctcctgatgctatccctccaccctcctcctaccccatgacaggccctggtgtgtgatgttccctaccctgtttccaagtttttcattgttcaattcccacttatgagcacgaacatgcagtgttcggttatctgtccttgcgatagtttgctgagaacgatggtttccagcttcatccatgtccctacaaaggacatgaactcatcctattttatggctgcatagtattacatggtgtatatgtgccaaattttcttcacccagtctattgctgatggacatttgggctagttccatgaatatagcagcatgatttataatcctttgggtatatacccagtaatggaatggctgggtaaaatggtatttctagttctagatccttaaggaatcaccacactgtctgccacaatggttgaactagtttacagttccaccaacagtgtaaaaatgttcctatttctccacatcctctccagcacctgttgtttcctgacattttaatgttgccattctgactggtgtgagatggtttctcattgtcgttttgatttgcatttctccgatgatgagcattctttcatgtgtctgttggctgcataaatgtcttcttttgagaagtgtctgctcatatccttcgcccactttttgatggagttgtttttttcttgcaaaatttctttaagttctttatagattctggatattagccctttgtcagatgcgtagattgcaaaaattttctcccattctgtaggttgcctgttcactctgatggtagtttcttttgctatgcagaagctctttagtttaattagatcccatttgtctattttggcttttgttgccattgcttttggtattttagtcatgaagtccttgcccatgcctatgtcctgaatggtattgcctaggttttcttcttgggtttttatggttttaggtctaacatttaagtctttaatccatcttgaattaatttttgtgtaaggtgtaaggaagggatccagtttcagctttctacatatggctagccagttttcccagtaccatttactaaatacggaatgctttccccatttcttctttttgtcaggtttgtcaaagatcagatggttgtagatgtgtggtattatttctgagggctctgttctgttccattggtctatatctctgttttggtaccagtaccatgctgttttggttactgtagccttgtagtacagtttgaagtcaggtagcgtgatgcctccagctttgttctttggcttaggattgtcttggcaatgcaggctcttttttatttccatttgaactttaaagtagttttttccaattctgtgaagaaagtcattggtagcttgatgaaggtggcattgaatctataaattaccttggccagtatggccattttcatgatattgattcttcctatccacaagcatggaatgttcttccatttgtttgtgtcctcttttatttccttgagcagtggtttgcagttctccttgaagacgtccttcacatcccttgtaagttggattcctaggtattttattctctttgaagcaattgtgaatgggagttcactcatgatttagctgtttgtctgttattggtgtataggaatgcttgtgacttctgcacattgattttttgtatcctgcgactttgctgaagttgcttatcagcttaaggagattttgggctgagacgatggggttttctaaatatacaatcatgtcatctgcaaacagggacaatttgacttcctcttttcctaactgaataccctttctttctttctcctgcctgattaccctggccagaacttccaacactgttgaataggagtggtgagagagggcatccctgtcttgtgccagttttcaaagggaatgcttccagtttttgcccattcagtatgatattggctgtgggtctgtcataaatagctcttattattgcgagatacgtcccatcaatacctaatttactgagagtttttagcatgaagggctgttgaattttgtcaatggccttttctgcatctattgagataatcatgtggtttttgtctttggttctgtttatatgatgggttacgtttattgatctgtgcatgttgaaccagccttgcatcccagggatgaagcccacttgatcatggtggataagctttttcatgtgctgctggattcagtttgccagtattttattgaggatttttgcactgatgttcatcagggatatggtctaaaattctctttttttgttgtctctctgccaggctttggtatcaggatgatgctggcctcataaaatgagttagggaggattccctctttttctattgactggaatagtttcagaaggaatggtactagctcctcttcgtacctctggtagaattcagctgtgaatccatctggtcctggactttttttggttggtaggctaataattattgcctcaatttcagagcctgttattgatctattcagaaattgaacttcttcctggtttagtcttcggagggtgtatgtgtccagaaatttatccatttcttctagattttctagtttatttgcatagaggagtttatagtattgtctgatagtagtttgtatttctgtgggatcggtgttgatatcccctttatcattttttattgcatctatttgattcttctctcttttcttctttattagtcttgctagtggtgtatctattttgttgatcttttcaaaaaaccagctcctggattcaccaattttttttaagggtttttgtgtctgtacctccttcatttctgctctgttcttagttatttcttgccttctgctagcttttgaatgtgtttactcttgcttttctacttcttttaactgtgatgttagggtgtcaattttagatctttcctgctttctcctgtgggcatttagtgctataaatttccctttacacactgctttaaatgtgtcccagaaattctggtatattgtgtctttgttctcactggtttcaaagagcatctttatttctgccttcatttcgttacgtacccagtagtcattcaggagcaggttgttcagtttccatgtagttgagctgttctgagtgagtttcttaatcctgagttccagtttgattgcactgtggtttgagacacagtttatcataacttctgttctttttcatttgctgaggagtgctttaattccaactatgtggtcaattttggaataagtgtgatgtggtgctgagaagaatgtacattctgttgatttggggtggagagttctgtagatgcctattaggtccacttggtgcagagctgagttcaagtcctggatatccttgttaactttctgtctcactgatctgtctaatgttgacagtggggtgttaaagtctcccattattattgtgtggagtccaagtctctttgtaggtctctaaggacttgctttatgaatctgggtgctcctgtactgggtgcatatatatttaggatagttagctcttcttcttgaactgatccctttaccattatgtaatggccttgtctctttagatctttgttggtttaaagtctgttttatcggagagaggattgcaacccctgcctttttttgttttccatttgcttggttgatcttcctccatccctttattttgagcctatgtatgtctctgcacgtgagatgagtctcctgaatatagcacactgatgggtcttgactctttatccaacttcccagtctgtatcttttaattggagcatttagaccatttacatttaaggttaatattgttatgtgtgaattcaatcctgtcatcatgatgttagctggttattttgctcgttagttgatacagtttcttcctagcatcaatggtctttacaagttggcatgtttttgcagtggctggtaccgcttgttcctttccatgtttagtgattccttcaggagctcttgtaaggcaggcctgatggtgacaaatctctcagcatttgcttgtctgtaaaagattttatttctccttcacttatgaaacttagtttggcaggatatgaaattctgggttgaaaattcttttctttaagaatgttgagcctggctgccccgtctgggaagtgaggagcgcctctgcccgggcgccccgtctgggaagtgaggagcgcctctgcccagctgtccagtctgggaagtggggagcgcctctgcccaggcgccccgtctgggaagtgaggagcgcctctgcccagctgtcccgtctgggaagtgaggagcgcctctgcccggctgccccgtctgggatgtgaggagcgcctctgcccagccgccaccccgtctgggaagtgaggatcgcctctgcctggccgcctcgtctgggaagtgaggagcgcctctgcctggccgctgtgcaatcttccaagcatgaagtgacagcctgtctgcaggggtacccaacagctctgaagagacagcgaccatcgagaacgggccatgatgactatggcagttttgtcaaaaagaaaagggggaaatgtggggaaaagaaagagagatcagattgttactgtgtctgtgtagaaagaagtagacatagcagactccattttgttctgtactaagaaaaatttttctgccttgggatgctgttaatctataaccttacccccaaccacgtgctctctgaaacatgtgctgtgtcaactcagggttaaatggattaagggcggtgcaagatgtgctttgttaaacagatgcttgaaggcagcatgctggtcaagagtcaccaccactccctaatctcaagtacccagggacacagacactgcggaaggccacagggacctctgcctaggaaaaccagagacctttgttcaagtgtttatctgctgaccttctctccactattatcctatgaccctgccacatccccctctccgagaaacacccaagaatgatcaataaatacttcaaaaaaaaaaaaaaaagcaaatcataaaaaaaaaagaatgttgaatattggcccccactctcttctggcttatagagtttctgccgagagatccgctgttagtctgacgggcttccctttgcgtgtaacgggacctttctctctggctgcccttaatattttttctgtcatttcaactttggtgaatccgacaattatgtgccttggagttgctcttctcaaggagtatctttgtggcgttctctgtatttcctgaatttgaatgttggcctgccttgctaggttggggaagttctcctggataatatcctgaagagcgttttccaacttggttccattctccccgtcactttcaggtacaacaatcaaatgtagatttggtcttttcacatagtcccgtatttcttggaggctttgtttgtttctttttattcttttttctctaaacttctcttctcgcttcatttcattcatttgatcttcaatcactgataccctttcttccacttgatcaaatcagctactgaagcttgtgcatatgtcatgtagttcttgtgccatgattttcagctccatcaggtcatttaaggtcttctctatactgtttattctagttagccattcgtctaatctttcttcaaggtttttagcttctttgtgatgggttcgaacatcctcctttagcttggagaagtttgttattaccaatcttctgaagccttcttctctcaactcgtcaaagtcattctccgtccagctttgttccgttgctgacaaggagctgtgttcctctgcaggagaagaggtgctctgatttttagaattttcagcttttctgctctgttttttccccatctttgtggttttatctatctttggtctttgatgatggtgacgtacagatggggttttggtgtggatgtcctttctgtttgttagttttccttctaacagtcaggaccctcagctgcaggtctgctggagtttgctggaggtccactccagaccctgtttgcctgggtatcaccagcggaggctgcagaagagcaaatgttacagaacagcaaatgttgctgcctgatccttcctctggaagcttcgtctcaagaggggcacccggctgtatgaggtgtcagttggcccctactgggaagtgtctcccagttaggctactcgggggttggggacccacttgaggaggctgtctgtctgttctcagatctcaaactctgtaacgggagaaccagtactctcttcaaagctgtcagacagggacgtttaagtctacagaggtttctgctgccttttgttcagctatgccctgcccccagaagtggagtctacagaggcaggcaggcctccttcagctgtggtgggttccacccagttcgagcttcccggccgctttgattacctactcaagcctcagcaatggcggacacccctcccccagcctcgctgccaccttgcagttcgatctcagactgctgtgctagcagtgagcgaggctctataggcgtgggaccctccaagccaggcgtgggatataatctcctagtgtattgtttgctaagaccattggaaaagcacagtattagggtggaagtgtcccaattttccaggtaccatgtgtcacggcttcccttggcttggaaaaggaattccctgacctcttacgcttcctgggtgaggcgatgccccgccctgcttctgctcacagtccgtgggctgcacccactgtccgacaagccccagtgagatgaacccggtacctcagctggaaatgcaaaaatcacccgtcttctgcgtcgctcatgctgggagctgtagactagagctgttcctatttggccatcttggaacctctccgaaatttattttattaaagggactccagtgaaattcatattaaattttacagtacagcaaagagtatttatgatctttaaacttgttttaaaaacaatatgtgcttttggaaaaaagttctagataagaccagataaaatatatatatacattatttaaatcattatttagtaataaaaatacaacaataaaacatatttttataatcatttatgctacatttccaaaatgtttttcaaactgtatcttaatttaaaaactatacacaatatatatgtattatgtagcacatatattaattaactgattcactaaccactatgtaaaaaccatggtgctaggtcaatgcagtagccatgggatagtagaaatagcccaaagatgatacttataagctcatagtctactagagcaatgcagaaaacaaaataaaggtccagttacagtggctcatgcctgtaatagcagcactttggtaggccaaagtgggaagatcatttgcgccaaagaattcaagacaaacctgggcaacatagtgagacccatctctacaaaaaaattaaaccagccaggtgtagtggtgcacacctgtggccccagctacttgggaggctgaggtgggaagatcacttgggctcaggaggttgaggctgtagtgagctgtgattgcaccactgcattccagcctgagcaacacggtaaaccctgtctcaaagaaataaagtaaaataaataaaaatataatgtattaagtaatagccacatatataaattgttacaggtatataacctacaggaaaggccaaacagtattaggtaagtatccaaccttggaagaataagaaaaggtttactaaatgaaggtaaataaataagttagatcttaaattttttgtagatattgccatccctaaaagagaggaaactatgtgaaagaagcagtctttttaaagtgcatttttattttggaaaaacagccagatataactgaaaattcagagatgtgggaaaaaactacaatggaggcaaatctctaaatgcaaaatattgagtcttatgctcttgaaaaaaaaagaggtttggattgaaaaatttatgtttctgaaaaataatctggcaataggtagagattatatgatgtcaagaagtcacccacagcatgaaaaaaaaacaggaggttatagatacaattttatcagaaaattccatgtctagaatgtctattgctatcactatcaatttacttatctttcaaaatctaactctacagtgcttcctacaagaatcattcttgaggtccgaacacagttagcaatcaaaacaaggctgacagatttgtccagtaagaaaacaatgagtaatttttggattcagacagtttattacctacataaacagcaaaagcaagaatagacaaaggtgccagctactagtatcccttgcacaggatgacattgaaacaaaggggccagatgactataacaaagatgtaggacactctgttgcggagaagcccatgccgtgctgcagtaaagcagttttataagctgtagctatgccccaaggagagcaaggcagaaagcccagtgctcgtcggaacctaggaaccaataagaaacgggctcctaactgacttcctaatagactgtgaagtaagtgagaatcaatcttgcatagtcagctgctcataagcctttcatattctcatgttccagaaggatcacaggaaattctgccaagatttagattggctgtagttaagccttgtctatgaagcccaagggcagatatgcaaaattgtcaggccactgtgatgaggctgttctcatagaactatgtacaaccatatcattgtcgtatttattatatcacagtagaaatattttgacctaaattgatgataaaaacatggcataaggccatgcttagaggattagagctaaaaacacacatttgagaaagacttttaaaaaaatcaatgacgtaagcctctaccttaaaatgttagaaaaaagagctgtaaactaaactaaaagtagaaggagataataaatattggcagaaataaaacaggagaaaaaagttaaagagaggctcaacaaagccaaaggttcattctattagaaagataaaccaagaaaaattgagaaaggaataattaatgtctgcaatgaaaggggacctcactacagattcagcagacattaaaagtgtaagatgatttgatgaataccttcacagtaacaaattttaaaaattagataaaaagtttttaagttctacaaaaacataacttactaaggctgacacacataaaaagaaactctgaacgattttagatctatttaaaaagtcatttcaggccaggcgcagtggctcacacccgtaatcccagcactttgggaggccaagacgggtgtggatcacctgagatcaggagttcgacaccagcctggccaacctggtgaaaccctgtctctactaaaaagacaaaaattagctgtgcgtggtggcaggcgcctgtaatcccagctacttgggaggctgaggcaggagaatcacttgaacccgggaggcagaggttgcagtgagctgagatcatgccattgcactccagcctgggcaacagagcaagactctgtctcaaaaaaaaaaaaagtcatttcatttcacaatttacaatcttcccaaaaagaaaactgcaaaccaagattgtttcacgatcaaattctacctaacattagagaacaaaatcacaccaatgcaaatcagctattccaaaaaagaaagttatataaaggaaaagatttaaaatggttgaaaaagtcacgttcttacaatctcacattctcccattttagtcataagaacggaatgattttgattattaaaaacctgacaaattctttaagagaaaaaagatgcaaaattcgaaaaacttttttacatgaggaaatagaataattctaaaaacttcagaattctaaaaaattgagaaacgaaatccactaacatataaaaagagtaatacatcacaacctaactgaaatgtttcgagaaatgcaaggttgtttaacattttaaaatcaatcagtaatggaatataagggaaaaatcatgtgattatcttaaaagatacagaaaaaagcaatatacaattatgaattaaaaaacaaagctcctagcaaaacaggacaaaagaaaacttccttaacttgatctttcttaattgacaaaaaaaaactataaacagcatactgaagggtgaaaaattaaaggcttttgttttgatattggaaataagaattgcctgatacatggtcaacatataaaaattggctatatttacatatttcaataacagaagataaaatttcaaaaaagatgctcattttcaccaaaagataagaatgttcatagcagtagcatctagaactgcacaaactggaagaaaaagaaaaaacaaatatcctttaacattgtacagcctgagtatgccgtatacaaaatgcttgggaccagaagtgtttgaattttggagttgtttggattttgaaatacctgtatcatatacttactggttgagcattcctaatccaaaaatccaaaatctgaaatgctctagcgaacacttcctttgagcatcaaaagtttccatttatttcttttgaaaatgagggtatttataaaagtgaccttccttacttaactattaataaaaatcactaaaacatttcactattatgacttatataaataatgtataatattctacattgaatagagtaacgtataatgcacttgtggcctggcataaagtaaaagcaactaatagtaaataactaccatatgctatttttacttacctcaaggagacctgacaagtacttcacacagatatctagaggctttgtgagaggagagtgtgagctccatcccggaaacgcagtgaggttagccatccctcgtaaggtccgctcaagggacggcaggccatagaaatgaggcgcatccgtcactttcagacactggagcagtttcagagccagctgcgtttgaaaaacgtaaagaagttccgagcatttcctatgtatgcaaaagagggaaaatcaaccaccaagaaagtataatgggcttaatgggctatcttactggctataaaaggttacttaaactcatagtaatagaaaaaaatgaaccagacaaaatggcagaaaatagtctctatcaaaatgagacttttcaaggaaagcataaaataccaactagagaatgtcatataaaatacaagtaacgattacactgggccaggggctgtggctcacccctataatcccagtgccttgggagcctgaggtgggaggattgcttgcggccagcttgagcaacacaacacagtgagacctcatttctaaaaaaatgaaataaaataaaattaaagtaaaaaaaattagccaggtgtggtggtgcacacctatagtcccagctactcaggaagctgaggcaggaggatctcttaagccctggagcttgaggttacagtgaactaagaatgtgtcactgcactccagccggggtgacatagtgagacccccatccctttttaaaaaaaaaaaaaaaaaggttggggggattgctggcaagatggtcaaataggaatagctccagtctgcagctcccggcaagatcgacgcagaaggcgggtgatttctgcatttccaactaaggtacccggttcatctcactgggactggttggacagtgggtgcagggcacagagggcaagctgaagcagggtggagcatcgcctcacctgggaagcgcaaggggtcggggaattttctccaccacccaagggaagccgtgacagactgagcctgaggaactcctgcacagatactgcgcttgtcccacggttttcgcaacctacaaaccaggagattccctcggttgcctaccctaccagagccctaggtttcaagcacaaaactgggcggccatttgggcagacaccaaacaagctgcagtagttcttttttcccataccccagtggcgcctggaacagcagcgagacagaagtgttcactccgctggaaaggggtgctgaagccagggagccaagtggtctggctcagcaggtcccactcccacggagcccagcaaactaagattcactggcttgaaattctcgttgccagcacagcagcagtctgagattgacctgggacgctagagcttggtgaggggacgggcgtccgccattgccgaggcttgagtaggcagttttacactcacagtgtaaactaagccactgggaagttcgaactgggcagagcccactgcagctcaacaaggctgccatggccagattgccagatttcccttgtctgggcagggcatctctgaaaaagtggcagcaaccccagacagggacttatagataaaacccccatctccctgggacagagcacctggagaaaggggaggctgtgggcgcaacttcatcagatttaaacatccctgcctgacgactctgaagagagcagtggacctcccagcacaccgatcaagctctgctaagggtcagactgcctcctcaagtgggtccctgacccccgtgtatcctgacggggagacacctcctagtaggggccaaccgacacttgatacagaagagctctggctggcatctggcaggtgcccctctggaacgaagcttccagaggaaagatcaggcagcaatctttgctgttctgcagcctccgctggcgatacctaggcaaacagggtcgagagtggacctctagcaaactccagcagaccggcagcacatgggcctgtcagaaggaaaactaacaaacagaaaggaacagcacgtccactcaaagatcccaaccgaaggtcaccaagaaaggatatcagtgatagaagatcaaattaatgaaataaaatgtgaagacaagattagagaaaaaagaataaaaaggaacaaacaaaggctccaagaaatatgggactatgtgaaaagaccaaatctatgttcgattggtgtacctgaaagtgacagagagaatggaaccaacttggaaaacactctgcaggatattatccagaagaacttccccaatctagcaagacaggccaacattccaattcaggaaatacagagaccaccacaaagatactcctcaagaatgcataatcatcaagacacataatcatcagatttaccaaagattaaatgaaggaaaaaatgttaagggcagccagagagaaagatcaggttacccacaaagggaagcccatcagactaacagcagatctctcagcagaaacctacaagccagaagagagtgggggccaatattcaacctttctaaagaaaacaattttcaacccagaatttcatatccagccaaactaagcttcataagcaaaggagaaataaaatcttttacagacaagcaaatgctgagagattttgtcaccaccaggcctgccttacaagagctcttgaaggaagcactaaatatggaaaggaaaaaccggtaccagccactgcaaaagcataccaaattgtaaagaacatcgacgctatgaagaaactgcatcaactaatgggcaaaacaaccagctagcatcataatgacaggatcaaattcacacataacaatattaaccttaaatgtaaacgggctaaatgccacaattaaaagacacagactggcaaattggataaagagtcaagacctatcagtgtgctatattcaggagacccatctcacatgcaaaaaacacacatgggctcaaaataaagggatggaggatgatttatcaagcaaatggaaagcaaaaaaaaaaaaaaaaaagcaagagctaccatccttatctctgatacaaaagacttaaaaccaacaaagatcaaaagagaaaaagaagggcactacataatgataaagggatcaatacagcaagaagagctaactatcctaaatatatatgcacccaatacaggagcacccagattcataaagcaagttcttagagacctacaaagagacttagactaccacacaataacagtgggagattttaacaccccactaccaatattagacagatcaacaagacagaaaattaacaaggatattcaggacttgaactcagctcttgaccaagcggacctaataggcatctacagaactcttcaccccaaatcaacagaatatacattcttcttagcacttcatcgcacttattctaaaattgaccacataattggaagtaaaacactcctcagcaaatgcaaaagaacgcaaatcataacaaacagtctttcaaaccacagtgcaatcaaactggaactcaggattaagaaactcactccaaaccgcacaactatatggaaaccgaacaacctgctcctaaatgactactgagcaaataacgaaatgaaggcagaaataaagatgttctttgaaatcaatgagaacgaagacacaatgtaccagaatctctgggacatatttaaagcaaaaaacaaaacaaaacaaaaaaggaaaatttcaggccaatatccctgatgcacactgatactaaatcctcaaagatgttgaataggtatttctccgaagaagatacacaaatagccataagaacatgagaagatgctcaaaattatttttcattggggaaatgcaaataaaaaccaaaatgataccagtctacacccattaggatgctataataacaggtgttggtgaggatatgaagaaaatgaaacactcatacattgctggtgggaatgtaaaatggtatagctgctgtggaaaacagcttggcatttccttgaaaagtcaaacatagagttaccattacagttaccatatgaaccaacaattccactcctaattatatactcaagagaactgaaacacatgtccacacaaaaatctgtatatgagtgtttacagcaacactattcataatagccaaaaggtagaaacagatcaaatgtccaccaatgaatgaatggataaacaaaacatggcatatctataaatagaatattattcagtcatagaaagaagtagtgatatttgctacagtatgcaaggagcttggaaacatgatgctaagtgaagaagctagacgctaaaggtcacattattgtttgatttcatttatgtgatatatccagaataggcaaatccacagacatagaaagaagactagtggctgccagggcccagaggaatgtgtgaatagggagagactttttcatggatacaaggcttctcttggggtgatgataaagttctggaattaggtagtggtgacagttgcaaacattgcggatatactaaaaccattcaaatgtacattttaaaatggttaaaatagtgactttcatcttaatatttttatttttaaaaaacagaattcataactagagatatgtatttgaaagtcatcagtgtaaagataatcataaagtcataggcataggtatgactgctcaagtagatttgtagataattaagagagaaccaggaattaaaccctagagaacaaaactgtgtgtgtgcatatgtgagtgcatgtgtgtagtgaaagagaccaagcaggtacaatcaggctgtaacagattaaactgaaacaaaaacaaacagaacactataactgattattatttaagtatttgaaagaagtatttcttaatttgaaagaagtacaaagtaaaactttgaaaatcaaagaaaacttgggttctatataaatgcacctaaacctgcaatattacaaatggtacctgtcagtaacttccatgaaattgagcagcaaggtatcaaaaagagcaatcagttctttctgaagttgttgcctgacagcagtccggatatcatctgtttcttctcgtgcctgtgactctgtcagaaccaagaggtctaacagtgggtttgcactctaaaaaatgaaatttgtaaaaaatgtatttactaattgaactatatattgtttcctataaagggtttggttgctaagcaagttctagtaagagctatattacctaactagtaggtgtgggcctttactgcattagtagagatgttctaaattcaaaagatgtttaatatattctcaacaaaagaaaaacatatttatcatataaaatagaaaaaaaggacgagaaaaacaaaaccacacataatcatgccacacagaaattgccactattatatattgatatataactctcctttttgtttctgagaatataaacagaattaaaacagtacatttttcacaaacccgtatcaagtgaaaaaaatcactactgtaaccattttttcctacttcccgttattaacaatatttctgcaaaaacattagtttaatatctgattgtttttcaacaataaggatttaccacactaactcctggataatcaatgatgcataatttcactaagctgcaacacacagtgtactcaagttggattttatcttatgtatgaattctgcaataaaattactaaatcaaaatattatagtagttttaattttttgatatatattgccaaattgtccctgtaaaaaatgtaccaatacatacaattacacaggacatgaaaagacccacagcacccaagccagtgctatgtggattattactgcaataatctttgccaccttgataggctagtaaacaaatactagttctttctaaagtttttcctcttttcccaactaaaaaaaaaatagataaaggaatataagaggattatttctaataatattgacaaaagaaaacgttacattaatcagaagcattaatagatatatgggatatttattaatcatctatgatgcctcaggcactgtgctaaaaaaaaaagatagtaagatttcatttgactttttgaataaactagaagatttgcattttcattcctgttttacagatgggaacatagatttataaagaggttaaataattgtctaagtcttagacagacaagggcagagcaagaagcatcttactccaaagctagttaatattccatcctcagcacagtgtcacatcactagtgcatgtaaaaacatacaaaaagagatacaatcaaaatgtaactattgttcttataaaatccttcacctaaaagagctcaactcaaaattaactgcattctctttagggaaaagaaatgaaaatatgtaaagaaacctctaaattgcttatagtatatagagatatatacaattataaataatataactgagagcttttggaaactagtagtgacattttgctcttattttacagtattttaacatctaaatagtttttttcccaactttttcttttatcttaagcaatatatgtctttggataaattaagattgaataagacataactgcaacttttatgtttcatacatgaataaaagaatcgaaatacacatttagtaaatcataaaaataaataaattttctataatgttctgagccctaaatatccaaaagctgactcacattcacgtgccttctgactcccaaaactactgacaaaatgaacaaactgtttataccaagacgcaaactccatcttgtaaaacaattttattattaggaattattaattctgatatgctgataaaaattaagtagaagctactattaatacatgaatatactgaaacagtatgtgtatacctaaaaattaagattctcccaaagaatctcatcctattaataacttgcttccacttgaagattactgaagtttttttttctcttttcacctttgatttacatgttaacactgaaattcagtgaacctcagcaataccacttgtaaaatatagggtgaattaccatttctcaagtacaatagagtagaataagatgtctctactgatgcctacagatgtcaagtgcttaatcatatctgaagtttttgtctttagacgttaggattcaatcctaattttaaaccaactacttgggccattattttgtcactgttgacctctaaaaggcaaccatttctataatgatggctcattttgtttacacacacagttaccactcatcatatccaactttacatccatcagcaagctatgccaaaagtaactgcaagaccctcaataatgtctgagtgcacattgagcccgttacgggaaagccagccaaggaaaatatatatgctgtgtagttctgctgagcttcaccaaaagaagaaaaaaactaacagccccacatttgtgaacttccatcaaaaaaatgcattccaaaaagaaaggtattcaaattcagcacttctaggttactataaacaaaatatcatattaaaaacagattagaggtgcaataaactcctaaattgcctaagaattacaatatgtttgtaataagtgaatgtcttgataaaacacatggaaaaaaatttcacaagagaaagttcctaaatcttccctcgggaagttagctgatttttcttttcacttcctcttagcattcttctgactaatcaggcgttcatatctgcctaattttgtttttgcaaccacaacttttgtatatcttttcatgtatgtccatacattcaaagcaatttacttggaaatgttattttactgagcttcttaaatcatttctcacttattttactcacttcaaaggataaactttaaaaggtacttgattttctatttccaggttccctttatcctaaacattggtagttatataacatatattaatttatcttgtagcataatatttagggagtaaacccaactgatagtgaacacttaagttcacttttgtgcactcttaaaagtagtattatttataacacttgtggtgataatatatgagataaagtagaagctttccgaagaaaggtttaataccatacaaaaccaaataagtaaatgtaactgtaccaaaaatccttttcaaaaactgcattaaaattatagtacaatcatctagagtcttgtaggaatttaattttaatttcataactatgaataaattataaaatatacataaaccttatgacatactacaaaattaacagtacatgtatggtgttacaagtcttaacaaatataacaagactgaaatcatatctaatatcatttctgaccatagtgataaaaaactagaagtcaccaaaagaaggaattctggagtattcacatatacataaaaattaagcaacatgctcctgaacaatcagtgggtcaaagaaaaagctaaaagggaaattttaaaatatcatgagacaaacaaaaatggacaccaaaccaaccaaaacttatgggatacagcaaaagcaggtctaagaaggacatacataacaataaacatctatgtcaaaaagaaagatatcaagtaaacaacctcaaggaactagaaaaagaagcataaatgaagccaaaacttagtaaaaagaaaacaatgaagataagggcagatacaaatgaaatagaaactggaaaaacaatagaaaacagtaacagaatcaagaattgagattttgaaaagatgaacaaaattgacaaacctttagctagactaataaaaaaagaagacaaaatgagaaacgaaaagggaagacattacaacagataccacagaaacacaaggaatcgtaagagactattatgaacaatttcatgtcaacaaattggacaaccaagtggaaaaaattctagacacatagagctaccaagatggaatcatgaagaaacagaaaatctgaacagaccaataataaggagattaaatcagtaatgcaaagtctttcaccaaaaaaaagcccaagacctgattgatggcttcactgctgaattccaccaaacatttaaagaattaatactaatctctgtactcctaaaaccaaatgaagaaggaatacttccaaactcactttatgacggcagcattacactgataccaaagccagacgtgggaactacaagaaaagaaaattacaggctaatatccctgataaacacagatataaaaaatcctttaccaaatactggcaaactgaaaccaagagcacaataaaaagatcactcactataatcaagtggaattcattccagggatgcaaggatggttcaacatacacaaatgcgtaaatgtgatacaccaaattaacagaattaagaacaaaaaccacatgattataccaacagatgcagaaaaagcatttgacaaaattcaacatcctttcataataaaaactctcaataaattaagtagaaaaggaatcccaacacaataaaggccatatatgaaaaacccacagctaacatcattctcaatggtgaaaagtttaaagctttttctctaagatcaggaacaagacaaggatgtctactctcaccatgtctattcaatatggtactggaaatcctagccagagcaattagtatatagaaagaaataaaaggcatccacattagaaaaaaggcaagttaagctgtccctctatgctgatgatataatcttaaatctagaaaaacctagactccaccaaaaaactttgatcttaaaaatgaattcaataaagttgcaggatacaaaatcaacttataaaaaatcagtagcatttctatacagtaaccgcgcccccccaaaaaaaaacctcatttaaaatagctaccaaaaaaaattaagatatttaggaataaatttaatcaaaaggtgaaagatctctacactaatgtccaagttgcaggtaccagaatgaaatcacgctccaaggaaaggggaggggagggaagaggaaaatggaaggaaaaagcaaaggagaaagggaagggagaagggaagggaggaaaagaaaggacaggaaagaagaaatgaaaggagactaacaacccaattgtggcggagaaccagcaaggacatcaagatacaattcatgaaaagaccgaatatgaaaaaatctccatctaattcaaaataagttatctatttataaaaccacaaaaacctcagcacacacgcacctctacaatttgactcagcaattacaattctagaaattcagtctataaatatacttgcatatataagtaaccttgaaagtaatacatggtttccatttttgttaaatcttaactagtgataaaattaaggttttgtgtgcttcttgtaattaactacatagcttattactgagttaataaatgtttattgagagctcactatgtgcaaggcactataataaatgctgggtatgcaataatgaacaaaacagtccctaccttcaccaatctacaataaaggaaaagataattactatggtttgaacattccctccaaaattcatgttgaaatttaatccccaaagtaacagtattgagaggtggggcctttggaggtgactggatcatgaaggccctaccctcatgaatagactaatccattcatggatagtggattaatgggttatcatggaaggggaactgatggctttgtaagaagagaaaaacctgagatagcacatcagcatgctcagccccctcaccacatataccctgcatcacctcgggactcttcagagagtccccactgcaagaaggctctcaccagatatgccctcttaaacctggacttcctgcaccccataactgtaagaaataaattttgttttttataaattacccagcttctgatattatgttaaaaacaacagaaaacagcctaagacgataataaacctctaaataagttttatatacacacaaacattcatatcagttagcatttctgacaacacagtaattcatatttttacataaaattatctctaagtttcgcaaatgtgttaatatataat

SEQ ID NO: 65 - DNA, 34757 bp, Homo sapiens
gggagaacaaacttaacatgacttacatcctcatttagcctttaaaattctctttgtccacaaacctccttgtttctggagttggcaacatactgaaatagaatatatacaaacttggaaacagctatgagcttgacctaaaaccttaactctgaccctttactgggaaggctttggtaggtgatacatcctctgtaatattttatcttctacatcaaaaaagtccttcattgtacagaattttgagagaaattaatgagacaatgtctcatagcacctgaaacaacgggttctcaagaaatactatttcattgattactcctcactttcttaactcttaccagacctattttgagtctgtatccttggtatcatcattttttctcaaattatttctaaggcagcattggtttgtgttataatcattaatagatacctgaattaagtgaaatatttcaaagtaaagccatatagtatcctgtggggaaaagcctatcttttgagccagaaagactggcttaaatcccagtattattgttcacctctttgtgggttttgtttatatgtttatacacattagttttaccatctgcaaaatggggataacagttttcacccttattcgtttcctgttactatttcccaaattgtcacaagcttagtgacttaaaacaacagaaattgcccaggtatggtggctcacatgtgtaattctaatattttggaaggctgaggtgggagaatcgcttgagaccaggagtttgagatgagcttgggcaacatggcaagaccccatctctacaaaaattaactagtcatggcggcacatgcctgtggtctcaggagggtgaggtagaaggatgacttgggtccaggagtttgacgctacagtgagccatgattgtaccactgcattctaacctgtgcatcagagcaagagcttgtctcaaaaacaaacaaaaacagaagttggtcatctcatagttgtagagatcagaagtctgcagtgtgtctcactggactaaaatcatggtgccagcagggctgtttttttcttgagcctgtagaggagatcttttttcttgcccttcccaacttttagaatccactctgctcccttgggtcacagccttttccaagttcaaagccagccatggccaggcaagcctttcttccatcaggtcactctgacctgacccttctgtctccctctcccatatttgaagacccttgtgattacctggagcccatcttgatgatcctgaataatttccctatttaaggtctgctaatcagcaaccttgattcccttttaccatgtcatatgatacattcgcaggctccaggacagacatggacatctttaggggccacaattctgccttccacagccactttatagatggttgttgggattactgggaagatgtagtaaagttcttagcacagtggctgggtatggagtgtagtatgttctgtagatggagaggttgacgtggaaaatgattttcttttttctcttttttatttttattttttgagacagggtctcactctgttgtccaggctggagtgcagtagtgcagtctcagctcactgcaatctcctctgcctcccaggctcaatcctcccacctcagcctcccgagtaactgggacaacaggtgcatgccaccacacttggctaatttttgtattttttgtaacaacggggtttcactacattgcccaggctggtatgatttttctaaaatcaaggcatttccttaatttaaaaaaaaatttgtttatttctttactggattagctgtttgggggaatcctgaagttaaccctatgtaaagattcacccagatggttcagtgtttccttcatagataaccccctttaaaaacactagcaatgggtcaggcatggtgaatcaggcctgtaatgctagcactttgggaggccgaggcaggcaaattacaaggtcaaaaggtcaagaccatcctggccaacatggtgaaaccccatctttagtaaatatatgaaaaatagctgggtgtggtggtgcgcacctgtagtcccagctacttgggaggctgaggcacgagacttgcttgaacccaggaggtggaggttgccgtgagccgagatcacgccattgcactccaggcctggcagtagtgtgaggctctgacacaaaacaaaacaaaacaaaacaaaacaaaacaaaacaaaaacccactaacaatgatgatgtgggggaaaatggccagacagaaataaaataagaacggaggtagatgacattcaaagtgtgtttcatggacctcacgttgattctcaaagcctgaagctcttcggtgtgcattagactaaattatcattctgctgagagtgcatctatgttttcttttccactgtttgtttttaaatgttgtaaaaacaataataaagtatggcattattagtaagcatgaattatggaagaaactcatctggaccagggaaacattgacattcttatttttttagaggaagacagagtatcccactatcacccaggctggagtgcagtggtgcaatcatggctcactgcagcatcaaccttgccggctcaagtgatcctcccacttcagcctccagagtagctggaatcacaggtgcatgccaccacactcagctgatttttttgtactttttgtagagatgaggactccctttgttgctaagactgctctcaaaatcctggtctcacaggatcctcccaccttagcctcccgaaatgctgggattaccggtgtaaactactacaccccacccgatcaacattatcctgattatacattaactcaggtgagcttcatatatgtgaagaaacactgaaagatcagattgcgaagtggtcttgttactcagcagcttccgccaaacaatcactaccatgataacatcaccaacaaaatgtctgtgactttcacatcccctgctttgagaagtagaaataaaaatgttctgggcatacataccacttatgaattgactgccaaactgttcttttaaaagtaggtcatttgatatgcctgttccactgataacatatcttaatatatagtagaccataaaatgtggaagatcataatatacaatctgcattcacttagcagcaactttttccttagctggagcacagatatacttaataccaaattagaagaaagtgtatgttattgtggaaataagattttaccattaaggcctaagaagcaaaagcaggaaaccaacaggaacccataaatggttggagatgacaaagtggactgtaatagtctttgtgtagttatttttttgagggggaggggacgaagtctctctgtcacccaggctggagtataatggtgcaatctaggatcactgcaacctccggctcccaggttcaagcaattctcctgcctcagcctcccaaatagctgagaatacaggcgcacaccaccacgcctggctaatttttgtatttttagtagagacagggttttgccatgttggccaggctgatctcaaactcctgacctcaggtgatccatctgcctcagcctcccaaagtgctgggatgtcaggcgtgagccactgtgcctggccgtcttcatctgcttttacatgatgcttcctgtttccctcggagaggtctccttggatgctctttgcccccgtgtgattctggtactcatacaacttgacatttcttctcatcacatgagactccacagtgagcatggtttttcctatccgtgttccgctgttcaaggaaactgcctgcagatgctcagagctttctttctcctttctttgtgctttatcagagcaaggatgattccggcttaccttgtccgtggcttctggatattttcacccagtagagggcgtgagtggaaactctgaatgcaggagaagccagaactcatcttccccttctctctctgcttcccaaggcaccctgagtcctccctcagggccctcctccaaggccctgtctcccgctgggcagtgtccaccatggcacgtgaccctggtttctggtctctgaagacacctcctcttcccattggttgcaagggttttggtagcttctgcagtcacctcttcctcaattctgttaccgttccttctttggcctctcagatctcccgagtccccttgatgaaaaaattccttttggttgaaaagtcccggaatagttcctgtttcttgcattattctaatatatttacgtctaaaacaaccctcccctcttgcatatggtacatgatgcatctagggattatccctggtaagaatttgctcatcttttattttctgtttgtttaattattttgaaggaattttagactcagggtaagtttagctttatagagagtcctagtatactcttgaccaatattcccctaaatgttaaaattttgcatgatcacaacacatttctcaaaactaagaaaccaactttgggatgatattacaaactaaactgcaggcatacgtttttaataaaaccaacattgccactgcttttaaaagtagtaaataaaaacacatatcatgtatgcatatgtgtgtatgtgcagatctctaattacgtatattgacttatttaagtttcacgtgtacttacagcacaaactacttttacaaggcagttggaattggatggtgagcttgccatgaggctagagccattcatttcccagatgttaaaaacatttgtttggcccgggtgtagttggtcacacctgtaatcccagcactttggaaggccgaggcaggtggatgacttgaggtcaggagttcaagatcagcctggccaacatgacaaaacccctcctctactaaaaatacaaaaattagccgggtgtggtggtcggtgtctgcaatcccagctactcaggaggctgaggcaggagaattacttgaacctaggaggtggagactgcagtgagccaagatcatgccactgcactccagcctgggagacagtgagactctctctcaaaaaaaaaaaaaaaataataataataatatttgtttgttccagagggctgtttccttaaaactgaaagtgaagattaccaaattcagtttgacaaacaaagcccccgtacagttcacgtgccaagtgagagaaggcaggtgccagtcccagcatgtgtgtgtgtgtgtgtgtgtgtgtgtgtgtgtgtgtgtgagtgtgtgtgtgtgttttggaattcacaggataaatactgtggtacaggaactgtcaggcctgattaatacttttgcactcgcggtgcatgtgccttgatctataggcattatgcttgctgcgtgggtccctcacaaggcagccattagcatcagcttccaagcagctcccccactgtgcacttcccttccctgtcatatgcttggctgtcatctttgctaaaggattttcaggttggtttgcaataagggtaaacttgggaaggatggagagcaatttcctttgaatgctcaggatggtgggggctggttcttagcacacagaaaatccatatgagaatgcctaggacaaagcgggggaatgatttctgtatacggtgtggtgtttagtacgtgaaacccttaggcccccttaaagtcttccgctccaacccttaaacagttaagcatatagattagcatcacttacatgcaaggacattgtaaaatatgatatgtttacaaaatgctatggaacgctagatgattattaaacataatgaggttgaaatctaattccataatatgaagatgcccatgttttattcagtagaataagcaacttgtagagtaacataagtagtgtgttatctcattttttaaaaaaggtagataagtaccaaggagggcagatcactcgaggccaagcgtttgagaccggcctggccaacatggcgaaaccccatctctactacaaatataaaaaattagccgggtgtggtggtgtgtgcctgtaatcccagctacctgggaggctgagggaggagaatcacttgaatctgggaggcagaggttgcagtgagctgagattgtgccactgcactccagcctgggcgacagagtgtgactcagtctccaaaaaggaaaaagaaaaaagaagatagattcagatactgcaataatttggaagctttatacagcaattactaaccagagtttttcttttgtaagtgagtttaggtgaaactttccctttctacattgtaagttgctttattgtttgtagattttataacgaataggtaatatttttggaattcccaaaaaatattgaatttcccatgtaagataatattttctacagatcatatcattcagatcttgtttcttctaagtaatgaaattctgatgcatttcatactgcctgctgcaagtaaggatgtctgaaatggacaataataaactaaagatagaaagaatcccttctgagtcttacactggatggacttcctgccctccagccatctttaaatatcatgccaggtatgaagaattaacatccctgatttttcttttagaaagaatattggtatctgcctagaaagaagatggttattaaaaagaataaaagcagacctgctttttcctgcccagttaatctttaccgggacaggacaaaccaatcactgcggaatgttttgtgggtgtcctgaggctgctgtaactgagtatcacagactggacgacttagaacatcagaaatgtcttcgcctagttctggaggttgcatgtctgaaatcaaagtgtgggcaggcttggttccttctgcaggatctgaggaagtagcctctttccttactcctagtgatttgccccacagtctttggtgttcctcggcttatgggtctatcactccagtctctggctttatcttcgtgtggcattttccatctgtctctgacttcacatggccattttatttatgaggacatcagtcatattgacctagggactcaccctactccagggttacctcatcttaactaatcacttctattaataaagtgactctgtgtttgaaaatgtttgcatttggaggtatccggggttaggacttcaccgtatctttttgttgctaacagacactttaaaaatatagatgactgcatcccaattaccagtcgaattgttttgggcattatttattaagagaaataaccattgtgatgcataagatgatctgtgagccctgtgctgcagacgagggccatgtggatggtatcgtgaaaacagttgcacctttgcttaaggcaaactcattgtataaaatacagtttgcaaaacagttattttgtgggtggcctatttttccctctagaaatggcattttttactctataaaggaatgaaaacttcttatacagagaacttcccagtggatttagactagaatctcattcactggtgctaataattccaaaatacattcgtatttaagatcctcatgccagtaattctagtactttgggaggccaaggcgggtggatcacctgaggtcaggagttggagaccagcctggccaacatgccaaaaccccgtctctactaaaaatacaaaaattagctgggtgtgctggtgggtgcctgtaatcccaactacttgggaggctgaggcagaagaattgcttgaacccaaggggcagaggttgcagtgagccaagatcgcaccacatctctccatcctgggagaaagagcgaatctccatctaaaaaaaaaaaaaaatcctctgtcccaataaatatggccacaggaaaattcctcatttcctcaaaataaagaacttctttcacatgaaatgtccatgtgctttccatcagcctttccctctccaggagaacatcaatgcaaacacttgtatttccctcctttgaaagtctctctatatagcttccgtcttttctcatgcacgtgagaagtcagctctgccattaacagcagatggatggagacacagccgcatttcccttctcacaggcactgtctgcttggcacgtggaactgcgtttccttgctcgcgaatcctcatgtgatacgcatctccccatccctcataacctccctcggtgcagaaactatctgtgaacagtggtaccggtcccttgacgttgtagcttgacttgctgaactctgattctgaatccatatatagacgcagggacactgcccagttttgcgtttaggaaagtcagactgtcatcggtgtggagggctgtgcagcagatgaggacagggccccaatcccaaactgaagaatcttttataggaagtgtcaggcctttttgcaggagcaaatttttcatcattgtatgtgtatttaacttttctgttctttggtaactggataaacagtgaataataaatgaatgtctgtgctcatattctcctgtcctttaaaaattatattaacttatttttaatcagtttattagttatatgctatattacatgctataatctgtagagaaatccacccccaaccgtgcccagtgatagtgactcaaatacagtaaaaatgtttggtttttttttttttggccaggcgtgatggctcacgcctgtaatcccaacacttcaggaggccgaggcgggtggatcacgaggtcaggagatcgagaccatcctggctaacaaggtgaaaccccgactctactaaaaatacaaaaaattagccaggcatggtggcgggcgtctgtagtcccaggtactcaggaggctgaggcaggagaatagcatgaacctggaggcggagcttgcagtgagccgagatcgtgccactgcactccagcctgggcgacagagcaagactcaggtgatctacctgcctctgcctcccaaagttctgggattgcaggcatgagccaccatgcccggcaataagttttcttaattcattgcaaaaggcagggcttttctgacaagagtgagctacagccattattctgattaatgctgccataatctaacatcacggaatggcaaactagagactatgggccacctctagcctctgtctgtttatgtaaattaagttttattggaacacagtcatgctcatttgtttacatattgtctctggttggcttcctgccacgacagcagagttttgcaacagagaccttatgtcctggctttgaagatacatactatctgcttctttgtaggaaaagtttgttgattaccggtatacagtgttgatctttgagcagggtacttaagaacgtagaggtgctttggcccaccacgaagagttttggaagacgtaagacttaagtggtacaaggagaggtcctccatccctgactataagcacttgtccaccttgatctcatctgtatagggttcagtgaaacttctgcttggaaaaatacatgtttgaaatcaattacatgaagcaaatattgtctagagtgtgaaggaaagggaacctgatcttcctgcttggaggtctacaaagcctcaaaaacagataggcagttgcccttaacctatacagcagagacattgtgtatctaaaggcatggatgtccagctaggaattatgacactcatgcagagggacatgaggagggggtagtttgggtctgactctccagttcacttctcatggatgtaattgatttcaaacttgtatttttcctagcagaagtttcactggaccctatagagatgagatcaagatggccatgtggttatagacagggctggaggacctttcctcctaccacttacatgtgggggttccaaagatttactaaatgctttgcatgtgttccaggtgtcagagcccatcacaggcagggttttgactctcagggagcctgcagtcttgtggagggaaggtgggcaataaggaagaagagacagcatagatattttgtgcaatttcagccagaggaaatatggcaagacagtagacagtgggggataaagtacagcaattttcttttatttaggaagattagagaattcctccttgaggaagtgatgtgagtttcaataaggatggaaagtaccatggaggtctagaagtgtctgggggcaggggtaacagcaaaaacaaaacttttcaaacatggaggtggtgttggtgcatgctggtgtcttgcaagtgctttcagaaggctacccttatcttttcctatccacctggcaaatacctcctcatatgcatgcaagactttgctcaaatgcagcaatccttgtgtttgtttctgctgctctaggcgggaatcccatcccctttcttccaccttatcctaaccgtcagtgctcccagtgttacagggacatgaggaggggttagtttgggtctgactctccagttcacctcccagcaccctgcctagtggtctacccatcactgatacttaacagttattgaatatgattatgtgtataccctagaaaaataagcaacaaaaccgttcattgtaatagatgacattgactgaacacttacttaaaacgcagtttcaagcccttagcatatataaagccattcagtatgccaaataaccataaaaggtagggactgtcattatttatagaagaagacactgaaacacaggaagactagtgtgtcagaagtcctacattctgataatagtagcacacacttcctgatgttcattatacatttaccactaggcgtttaatgtggattttgcttataatcctcataaaagtctctggaacaaatgctgacatgatactcgtttcgaggaggagagaatcagaatacagaaaggtaaaatcacttctccaaggttacgtggctagtgcgtgagagaactggctttcaaattcacatcactttaatgtgatgtgttggtattagaaagggaaagcatttcaaaagccctcaccacagtgtcataaagctggctgctcatggtaaacattccaaagaatccaccaacacagtgtccttggagtccgtctgcgtgcctgtgcaactgcaccttgcttctcttggtgaaaaattcacctctttggaccctgtgttcactcttgttgttgtcctccccttagatgaggaaggagcagggccatccgtaaaaacagagtcatagggtgaaaacacatcacagagaatgcaaaagggttatttatagtccagagtgggaagctgaaaagacactgtgagaggaacttaatcgtttcccaggggatcagggagaagagtggacagtggtgatgccacgctgcagagggtcaaggttgcataccaattaaaatgacttccagacacttaacacacacatggtacttcgctacagaccgctgacatgttccagccaggaaggagaaaaaaaaaaacaacttctgatgtctcatgcctctgtcccccccttaaacagtgaggcagctgggctaacactgttgttgccaaacaactctaataatttcaggttccatgataatgagttggtggccttataactctcgtttgcatatcttggtacaagggaaaacattcagtccagtatgactctttaaatagccatctatgccaagccccacataaaaggtgggagggcttgttgatgttccctttttctgcaaactcatttgtgaaactacatcaattacagttcaatcagttctcccattcttttttcttctcattaaacttatgcctttctgcttagttaggagaggactgtaaactcagcttaagcaaaaataagaaaaataagaaggacttattcattctcatgaaacctatgcgtctaagggtaggagactgcctttttggtgtgcgtaaacctgtgcccctgagaaactctctgcttctcaaaactgctttcatctttgttggtttcctttttttttttttttttttttaataactttcattttaaactcaaggttacaaatgtactgtttttacataggtaaacctgtgtcatggggacttgttgtacagatgatttcatcatccagatggtaatcctagtacccattagttatttttcctgattgtctccctcctcccaccctccaccctacaataggccgcagtttgtgttgttcccctctgtgtgtccacgtgttctcatggtttaagtcccagttttaagtgagaacaaggaatatttgattttctgttcctgcgttagtttgctaagtgtaatggcctccacttccatccatgttcctgcaaaggacataatcttattctttcttatggctgcatagcattccatggtgcatatggaccacattttctttatccagtctatcattggtaggcatttaggttaaactgaaatcataacaaacagtctcttgcaccacagcataactaaattcaaaatcagtcagaattcactcaaaaccatacagttacatggaaattgaataacctgttcctagatgacttctgggtcaataatgaaattaaggcagaaatcaagaagttctttgaaactaatgagaacaaagataaaatataccagaatctctgagacgcagctaaggcagtgttaagagggaaatgtatagcactaaatgcccacatccaaaagttagaaagatctcaaggtaacaagttaacaacacaattaaaagaactggagaaacaagagcaaacaaatcccaaagctagcagaagacaggaaataaccaaaatcggagctgaactgaaagagatagacacgaaaaaccattcaaaagatcaatgaatccgggagctatttttttttaaacaacaacaataacaacaacaaaacaaacgattagctagatgaataaagaagaaaaggtagaagattcaagtaaacataatcagaaatgacaagggggaatattacccctgggcccacagaaatacaaacaaccatcacaagattatgaaaccctctctgcacataaactagaaactctgaaagaaatggataaattcctggacgcatagatcctccccagactgatttacaggaagaaatttgttttactttcaagcacgttctcatattgtcaccaaagctccacacttaaaatcccttgtattagtttgataggactgccttaacaaattaccacaaactggtggcttaaaacaacaaaattttattctctcacaatttgagaaggcagaagtctgaaatcaggatgtcagcagggttgattcctactagaggcttggaaggagaatctgatccttgcatctcttttagctccaggggactgccagcaatccttggcttatagccacatcatttcaatctctgcctctgttgtcacatggctgtattgtctgggtgtctctgtattttaaatctccctctcctttctcttataaaaacactagtcaggccgggcgcggtggctcacgcctgtattcccagcacattgggaggcctaggccggcggatcacaaggtcaggagatggagagtatcttggctaacacggtgaaaccccgtctgtactaaaaatacaaaaaaaaattagccaggtgtggtggcaggcgcctgtagtcccagctactcgggaggctgaggcaggagaatggcgtgaacccgggaggcggagcttgcagtgaaccaagattgcgccactgcgctccagcctgggtgacagagccagactctgtctcaaaacaaacaaacaacaacaacaacaacaaaacagtagtcattagtgtcaggctgtaccctaaatcaaaaatctcaagaggcttaattacatcggcaaagccccttttttccaaataaggtcacattctcaggtaccagggactaggaagtgggcatatcttttcgggggcacattgtaattgactacacatattactgtatcaaccccattgcaaacagagcaaaccccagaaatactgggctaatgctcgttagctctgatcacctggcctgactcacagatcaacctttaggctaatcactgcagctagaaggacatgtggcaaccccagataaagaacataccatttaaagaccacacacatcacacaaaacctattgagagacgcttgacgaacaaggtttgtgctcagtgtgttaagtggatgacatgatttaaaaaaaaagtaactgaagagctaagagagagttatggtggaagaagtcgttacacaaaggtgctacataattgctgctaggttcgtgttagccaaaggggcttacaccattttcaagcctttacaagacctgagagtgatgtgttggtttgagttggtgtttatgtggaaagggaatatgtatggaatattattaaatagttttactgaattattggcatattgtaggcattccttaagtactttattgaatgatagcacaaaatattgctgaatatttttgctacattcttggcaggttgtaggcatctcttaagtatagttctgcaccacataatgacgtttcagtcaacagcagactacatatatgactgtggtcctataagattataatggaattgccctatacagatgtataattttttatcttttatatttttatcgtaccttttctatgtatagatagatttagatacgtagtacttaccttttaatgacagttgcctacagtattcagtacagtaacaagctgtacaggcttgtagtctaggagcaataggctagaccatatagagtgtgtgtgtgtagtaggctacaccatctaggtttgtataactgcaccgtgtgatgttgtcacaaggatgaaatcacctaacgatgcatttcttagaatgtatcctgactcttaaagcaacatttgtggtttattgactgaagggataaaaaataaataaatgaatatatgaatacaaaacaatttttagaagataaatgaatgagtgagcaatttgtccttctctttcctcctgagattttctatttttaaaagtgtgcttgtatttttgtctttatatttaaataatgatttaaatgatttatttaatactgaagccactgatgagctgagaactcataacacattgctaggcacagagcaaatgtgaaatttagtttttgttgtttttatccacatgttgttctgccaagttgggcaacataatgccccctcagaatgctagttaatgcacttaattctctcagggtcttcttactttagactctttgacatccttgggcaattaaagattagctattttaatgaacacaccacatcttttacaaagcctctttggcaaaagacctttgtcagtccgccatcgacatatattgcaaattacctgctgtgtcccttgaagtattatggaaacgggaaacatatgggtggactggcacaggctctgcataccccattccagaagcttacattgtagtaaggcaatatcaaaacatgcatgcaaatgaattaggttagtcaatttgagattatctgggagggggctgcttttgtgcacaagacagagctaacctggaatttgaaaggtgcagttgggcttagctgtttcagtgacagtggggagcagagatgctgagaagggcctgagaaggacagtgaaacccaaatgacagctcaagtgttctgattgtcactttcatgcaacccctggtactgagtccatgctgcatattgttaggtgaaaattctttttttttttttattatactttaagttttagggtacatgtgcacaatgtgcaggttagttacatatgcatacgtttgccatgttggtgtgctgcactcattaactcgtcatttaacattaggtatatctcctaatgctatccctccccctgccccacaccccacaacaggccccggtgtctaatgttccccttcctgtgtccatgtgttctcatcgttcagttctcacctatgagtgagaacatgcggtgtttggttttttgtccttgcgatagtttgctgagaatgatggtttccagcttcatccatgtccctacaaaggatatgaactcatccttttttatggctgcatagtattctatggtgtatatgtgccacattttcttaatccagtctatcattgttggacatttgggttggttccaagtctttgctattgtgaatagtgccgcaataaacatgtgtgcatgtgtctttatagcagcatgatttataatcctttgggtatatacccagtagtgggattgctgggtcaaatggtatttctagttctagatccctgaggagtcgccacactgacttccacaatggttgaactagtttacagtccctgttaggtgaaaattctatggtccatttcacaactacgtaccacagaaaagggagatacggacaacactggaaaaacaaaatataagtatgcaaaggaacacagacttggatatgaggaaggggcataaatgctatatttaagcacatggttactgcctttcctaaggagtaagccaggaaaagaaactttgggtcagttaaatatctcgttgcttcctttgcaaaagtaccttttaatagtctgtttttagagttgtttaaaaagaaaaaactgtcccttgcctactttaaattcttgacatttttttctggttttggtgagatcagggtttttgcagggcagtatccttcattatatatgtcagaaggctgagaaatgagtggggatggtgaatcaaccacagcccttctgaatttctcacaaggtaatctacctaacagaacataccagtttccacccacctttgttttggttagagtgatattttgtcccttggcagtgaggacgtctttccttcacatgatttttgtaagactgtaccctaaaagtagccacagtgcagctgtgttttatatgaaaacaaatggggttttgttgggtacattttgtggcatttcttgaggtcaccagaaactcctagacgtcgttgtaaaacaaagaaagaagaagaaaaaggctggaaactcactcctcctgctgttcttatgtcaagtcagtgaaggcaattctttaattttttcattttttcagtgaatacttagcacataccatgtataaccccccatgtaagaccagccctttgtcttctaagaaatgacattctgggctggacgcggttgctcacgcctgtaatcccagcactttggtcgaggtcgaggcaggtggatcacttgaggtcaggagtttgagaccagcctggccaacatggtgaaaccccatctctactaaaaatacaaaaattagctgggtgtggtgtcgcaggcttataatcccagctgtttgggaggctgaggctagagaatctctttaacctgggaggcaaaagttgcagtgagtcaagatcgtgccattgcactccatcctcggccaccaaccctatctaaaaaaaaaaaaaaaaaaaaaaaaaaaaggtattctggtggatagtgggggagtggcacacccccaaaacaatttcacaaacaattatttaattgcagttgagttaagtgctaaagtgagaaggacacagaatagagtcgatttaaattagaaagaactaaaaaatgtagctaatttcttcattcctgtaactctgggtttgagacaacaacaatttgagtgaatcagtgaatgactgcatagatggcatgtataggtgtcaagtaaaaatcgtcttgtagctaaatcctcagttgtgaaatgggatacaaagtccaagctcctttccttttctaggtatttctgatgggattcactcagttcgttaaaactttaagaaagccctctctgtctgttatttttctctctgcctactcagatggttcctccattctaactatggtagaggccaaccttgtcatgattttcagaactatgtagttccccaccgcccccgccccaagaaatgcagagcaatctgccttatcagtatctcttccaattaatgtaatcttgtttctgttatttccaccatatttttcaatccagtgagcctcattacatttgcaagtgcattaaattagagcctctatagaaggagaatgatgattatcagctaatttaattatgtttctacatttgcagcatttaatgatgtctgccattgttgttggggattcttacattggctccaggtagaaattagctctgatcccatgtaaagtttacgttatcagataatacttgagagctcattgaggtacatgttcagtaatttttgaatctaatcaaaattgatttatgtgcaatcaaattataggaataaagaaacagcttcacctaatttagttgccgattatagtgttgcctgcctctgaagtcacaccaatatgcgtctcttagttttgtaccaacattgcatcaaggcctaaaattctgcaggtttttttttttttttttcccaaattgcatagttggttctgtatttctgaccttctgctgtccatcagattgaacatttatgccctctgattttgtgtcctgttcaacaaatgttgcccgggtgtcctttaagtgttggccatgtgactcttgcactagaggcccaggtcacccatgaacctagaagagaagatccatggtgtggaggagtgggtgttgcaggacctgggagctgaggctcgggagggctgattcatcattcttcctcctttgctgtggattctcaaccaaggcaaaaatagatacacacactcaacagggattaaggtacagaattcacgctgggcatggtggcttatgcctgtaatcccagcactttgggaggccgaggcaggcggatcacctgggatcaggagttcgagaccagcctggccaacatggtgaaaccctgtctctactaaaaatacagaaattagctaggtatggtggtgcgcacctgtaatcgcaggtactcaggaggctgaggcaggagaattgcttgaacccgggagacagaggttgcagtgagccaagattgcaccacagcaccccagcctggatgacagagtgagactccatcttaataaataaataaaataaaataaaatagaaataaaataaagtatagaattcagtttatcaccagtgaggctgtgttgtaaacatgcttttatgtttaacaagcactttagtcatagttattttgtgccagacacaaattggaaggaccttatacacaaaggccctttgaattgttatgatagcctaaatacaaactattattatcctccatgcacagtttatagacgaagaaactgaggcacagaaggctgggctatgttgccgaaggctacccatctgccttctgaaagaaccagggttctagtcctggcggtctggctctaaaatccatggccgctgaacacaaagtcctattgtgcctcccaaagctgaaattagcattctgtcatccaacccgcattactcctacaaccatatctagatcttgggatgggcagagtagtttggaggatattggtccagcacaggggaatgagatggggctttgaagctggcctctagaaggcggggccctgaaacgtccctacttaggtgtgcttacctgttctaggtataccttacctactctaggtgagcttaggacatacggatcaaaagcaaaacatgcactgcttggaggaagtgagacagagaaagagagatggagagaaagaaaaacttttccattttgaaaagttacccatcagaaaagtctctatgatgttgattgggtgaggaagaatattggaaacttgctccctgaaacagtcataacacagtggaggatttgagtaagtctctaggtctcaaaggaggaagcaggaaggatgagaagataagaactatgaacgctagactgagaatatactattaacgcctatacttaagaatataagatgttcttgagacatgtgataaagtaactttccagaaaaatgagcagcacactgtgaaaacaaagacgcaaaagtgaggtgtcagtcatcccccctctgaggccggagggagggtggagatttggtgcaggtcgaaactgaagccaattgataaaatgctgtgtgtgccctacaaggaagagagaaggtttgaataaaataaagtgtgtctcagtacaaaaggagaagtttcacaaagcatttagacatcttataaaatggagttgcttcatcactccctaaaggggccatcctcaactgtctcctgttcaaggcccactctcagcctcgctggatgtcaacagccataaccatgtgattgttactgcagcagagcaatgtctccaagtgtgcaaaggacatctctgggtcactgagcgtgaatgtccatgagcccagccaggctcccttctctgttcaggaggcaaagtttttccacttcgcagtccccaagatgtctctgtgatactggtatggcgttaccttctgcctcttcctgcttacgggtaccttggtcatctcaccagtctccctgggggttagcatcttaggaatgtgtactcaatgacagccaacgtaaattttgcaccttgctcaaaatttgactgctttcccgttaacggttcattaattgaaaactaccggtatcttcctaaacctagagtatgtcccaacagcaggatgtgattttatgttttgtggtacatggacatgcattttgttgtaattgcagatgtatatgtatgaggctggttttcaaatatagaaaatatgaaagaatcataatatactatatacccagcattaagatgttacaattcacatttttatcatatttgttttatctcttatatatccatcacttcatctaccaatccacctcattttgtttttttatgcatttcaaagtgacttgcatcagtatctttcacccttcagcagggtgtaaatctttaatgagagctcatggtttgtttgtggtcttttatttttctgaggtaaaatttattgatactgaaatatacaaaccttgaagggaccgtttgatgaggtttgacagctgagtacacttttgtaacacgaagctctgtgaagatatagaactgtcattcttccaaagtttaggtatgatctgtatgtttattagaaaaagaatcacagcctgaccagtatggtgaaaccccgtgtctactgaaaatacaaaaaattagccaggtgtggtggcatgcgtctgtagtcccagctactagggaggctgagacaggagaattgcttgaacccaggctgcggaggttacagtgagccgagattgcaccactgcactgcagcctgggtgacagagtaagactccatctcaaaaaagaaaaagaatcagcatacatactaaacctatgattccatgaacagtttaaatgaaagagtacatacttttgtgtgtgtatatgtgtacctggttacatatatgtgtgtataatttacattgataagaataatgcagtatgcagatgtagcagaatttgtaattgtgatggaagttcttctgtatttggcaattacaggcctagggaaaaggtaacctcatcccattagcattgtcttcaaaaagaacacgagcatataaaatgtgcgaggctacactgatgtaacgtccaagataaatggaaagaaacacagtgttgctcgtttaattgaggatgtttaacgacttttggccctgagagtaccaacagctacaatttttcaaagtcagccttgatttatgttttattttttaagtactcattaatgtcacaaatagttaagttgggatcagctgtcttcatttacaaaaaatgggttatactttcatcttttgaccctgaaacgtgtagataaaaatcaacattaattggcaggatgaatgagggtggttagggtgggtgtctggctgcaagattcttagagtattgggagagatgctcagagccccttaactggagatgacaacgagattttaattaacagcaggtgagtcttgtggtcagccatttgacatataggtggatcacaaaatagcctttcctttctaaccacatttatttctagcttaattagtccttctgagatagcttcgctattagccacagcctctccatttaagatccttttaatcagacgttttatttttttattttttattcttctcattttagcactagcttaatgttatgaaggacctggactaactcattttaatgacctctgctacataaatgctaattttacatttggccttatttcggtaggttttttttttttttaaaaaaaaaaaagaccattgctttcagaaggagaaaaatggaaagattaaaccccttagtgtcatctgcctgaaaaatcctgtggtttcttctgacaggaagagggttttcaaatccctccttggtctaagcttctgtgcttgacatctcattattttactcagctacttcagcatcaccttcacccagttaattaagtaactcattgaatgtattattcagttttgattcccctgtctgtgacagagagggatggaagatgcttcttcatccttcttctcctgcctttttctcttctgcccacacccaaggaatggaaaagagaaaggagaggagagaagacattaatttcaaaatccatccatccatccatgcatccatccatttctgcagcagattgtttgatgtttttaatgatactcaaaagaaagtgaagttgatgatggtaaggttaatggtcataggtcttaatggtgatataacatcagtttgcaccaggcactgttaaaatttccttctaacatggtcttatttcgtacttaaaacagcctgatgaggtaagcactattcataaggccactttacaggttaagaaagctaagatctagtcaactaatttgttcaagtctccttgctagtaggaatcagaaacccaatttgggcccagaactagctgattggtaatacttatattccctacagcatttctgttaagtatctccatgtttgtagtcaagtttaaattcctaaaatttaagctggaatttatgatgaaaataccatgagaaggaggttgaaattgtagttgacctatgttacccgacctgctcgttacaggagttaagaaagaaacttgacttcctctagggcagtagtcctcaaaccccaaggaccaggacatttggccaaacagctatgataaatgctgctttatttgagtacattagacttcaattaaaaaaatgttttaaagtaccttattgaatgcatttagatttgggggagggaaggaggctatacttggacctaactccttggttgtcaacccagctggaaataagcaagacatgatgtttaatatgaatgaaagtagagagagagggcatttggaggggggttggtgcagagggaagcagaaagaattactaacatgaaaaggcagatagaaaatttagaaggtcaaaggcagagtaattgaaatagagcctcggaaattgtgaatctgagaaagaactggaggttaagtgataggtaagaaggaagataaggacaagtaaagggatggaataaaaccaaaaatggggggtgagtgtgtgtgtgtgtacgagagacagagatgcattttaatgcatatttaagaaaaaggaaagtagaaccttataaagaagatgaagtagaaatattttttagaaaacactttttattatgaaacatatttttttttttgtaagggaaagttcccagtgacagagtgagctgtgtagcaacgtgtgtaaaaagcagacatcacattcttaaagttactccattcgctcctgaacaaatattaagtggaggttttgttctgggtgtcagaatacagcatggaaaaaagacaaaggaaagtctctgctttcatggagctaagaagctagttgatgtggagatagaaaaataaacaaggaaatcaaggttatcaatgcaaataatggtacgtgcaataaagaaaacagaacagagaggataaagcattgctggctgggggaagagctcactgatgagctggtgtctgaactgaccttggggtagggaggaggagcagccaccgggaggctcagagcagcagctctgcagggggcgggggtagagcgggtgcatgcaaacaccccaaggtggccacaaacttaatgcatttgagaagctgtaagaaggtcattgtagccaaagaggagtgagcaggaaaaggtaggagaggtcagtagcgaaatgggcaaagagctatgttgggagctgggtttattctcaatggaaggagaggccattagggtttcaaatagagaaatcacactctatttggataatgtttggataatgtttggacaatgtttagtaaggatgtgctggaaggaggtgctgggtttggtttctgagtctgtcccttgttaattgtgtgtcctggacacagttactgcatctctgtgatccttcacttcctcctccttgaagacacttaactgcatcgggtttctttagaaggaaagctggaagaactttagagtctgttttccctgcatgctagctacaaactgaaaccatcgcaaacaacaaggtcaaaacatctgtgaaaccttgcaccagttgtaataaagatagccagggagaaagaaaaaaaaaaaaggtctgaacttgttggagaaacaaaaggacctcataaacagtatggagaccagttgtgtgttgtcatcagtgacttacctgagaatgatattcctgtggttatgaggatagtgttacagtatttccttggctaagtgtctgtggctgttatccatgtgcagaataaaagtccacttgaggaggagacagaggctcctgtcttttaccaatgttgatggatttcagtggaacaaaaatgagtctcttgaggttagaaggcaggcctggccatgggtgttttgcttgagctattccactcatgacactgggcctgactgatatccggcgaaggccttctttggctgaagtgcttgccaggcctaaccaacctggaatttattgataaagcttaagcagccgcaaggcctatgacctcaaagagtgacttaggctgactttatcagccttggctcttcttttcattatatttgctattactggagctgctctcttttcttaaaacctgttaaccttatacaaggggatgggaccatttgagctctcagacaggatgctgatgggaaattgtaagccttcgaaataggttgagagcttcctgttgtttgggttctggcagaggttacaaaaataaataaataaatataaaaaggagagggatggggagacattgaaaaataaatacttgatgtgttttcctggagttgagctggcttcttcctgggacatgcttttttccagcccttggaagaaagttgcagcgattgtgcccacttcacagatgcagctgacgtgcacccctgtgctgcgtggggatcttagcagggcaggtcagatgtccagaactacttacatcctcacatcagtggcttatagaccaagaaacagtcctctccaataggtgcacagaaagtgttcttgagtctttatttttattttattttttttgagacagagtgtcactcttgtcgcccaggctggaatgcagcggcacgatcttggctcactgcaacctcctcctcccaggttcaagtgattcttgtgcctcagcctcccaagtagctgggactacaggcatgcactaccacacctggctgatttttgcatttattattattattttttttagtagagatgggttttcaccatgttgagccggctgatcttgaatacctggcctcaagtgatccccccacctgggcctcccaatgtgctgggattacaggcctgagacactgcgcctggccacatgttctggagtctttaaatcaacagactgtttaacttggctaaaggaagtcaagtagttacttggtttccagccagttactgatggctgtaattagccacatgttttagtgactttggaatcgaggctctagccaggcgctgtagctcatgcctgtaatccttaggctttgggaggctgaggcaggaagatcacttgagttgaggagtttgagactagcctgggcaacacggaaagatgtatctctataaaaaaataaaaataaattagccatgcatggtggtgcatgcctgtagtcctagcgactcaggaggctgaggtaggtgggaggattgcttgaggccagggggtggaggctaccataagcgatgaccgcactactgctgtccagactggacaacatgagtaagaccccatctcaaagaaatccaggctttgtgtaaaccgatgcatttcttattgaataaacctacacacacacatacacacacacatacacatacacatacacacagactatatctatattctactataccagttattgtgagtaattcatggaggttcagaatgggtagaaaagtcaataaacagtaaagttgccttctgttgtgtgctcattcactcttccattaaaaaatatttctgttactcctttaagaaaatgattagtgcaacaggaaagcagattggctgagtccctcagatcacccgcttctgagtcaaaccaataaggttcatgtcccagatccaacaactgtcagctctgtgaccttgggcaaaaaaccaaacctccgtgagtatgtttactctaaaatagggataatcactgtggctgcctcccgggcttagtgaagttgcatatatatttaatataatagatgatacatacttatataatattatatccatttaatagaatatatgatatatacttttatattttttaatttaaatataaaagtatattacatatttaaagtattcaaatatataatattaatctatgtaatatatgattaaagtattatataaatggaaattacattatataatacaaatatatgtatatatgtaaatatgtacatatataatacaaagatacatatttgtattaaatatataatacaaagatatatttgtattaaatatacaaagatatacatatatttgtactaaatatataatacaaagatatacatatatttgtattatatataatacaaagatatacatatatttgtattatatataatactttaaatttaaattcaaaatatatattataaattaaaaatacacatgtatatattttaatttatataatataatataatttaaattagtaatttagtttataattattacatatattatacatgttttaatttatatataatgtaatataatactttattatgttacacaaattatatatgacatgcatattttaatagtttaaatatatgttatatattttaatttatatatcatatatattatatataaagtattatatgtaagtatacattatgtattatattaaatgtatatgatatgagtataatatattacgaaagttttaatatatattacataatatgtacatatttttaatttaaaatatataatactttcaatttatatattcatcactaaaaatgattttttggaacattagttcttgttgttaaccttgtctctgagtagctgataacttcatgaaaaagtcagatattgtataaaatgccctgtaaatataagtacaagtgaaatcatttccaccatagcccatgatccttatccatgcaggaccaaagacttggtgccacaaggaacagtcaaatctggatggggaggtagaggaggaagtgataacaggtttggtaaacagataattgggcgaacagagggaaagtgattcagcaggaggagacagtgagccaagtttctggaaaataaaaagaggtatcaataaaaaggttgacagggagcatagggtctgggaggaacatactagaatatgagtctaggaaggaaggtggcataggcacagaagtaatttcagtaaatccaatgagtcttacggttttgtgaattcaaaattatttttggaaaatcatgctgcctaagagagatcaatttatttttatttattttacccaacataaactattttgatgcacttgaccagtcagtcttagggtttaggtcactatcatattcacctgaataagtatagtctgactattccttttattcaaaatgttcgagaccagaggtattttggatttcagatttctttttcagattttggaatattgacacatacataatgaggtatcttggggatgggacccaagttgagaaccgtcattgccttatgctttatatgcacatcatacacataacctgaaagtacttgtgtacatgtttaataatttatgcttgaaacagttttgagtgtattttgactgcagtccatcatatggaggtcgggtattgaattttccacttgtggcatcacctcgcatctcagcagtcagacagttttggatttgggggcacttggatttgggattttttcttttttgagatggagtctcgctctgtcgcccaggctggagtgcagaggcacgatctcggctcactgcaagctctgcctcccgggttcatgccattctcctgcctcagcctcccgagtagctgggactagaggcgcctgccaccacacacggctaattttttgtattttcagtagagatggggtttcatggtgttagccaggatggtctcgatctcctgacttcgtgatcagcccggctcggcctcccaaagtgctgggattacaggcgtgagccaccgcacccggctggattttggatttttagattgggagtgctcaacctttaataacaatattaaaaaattattaaacctctaattactgtagcacatatcagaagatttctcttttatttggtttaagttattttggagaaataaaaattgtattttttgtgtgcatgatcttttgaaatgtgtaaacattgcgaaatgcctcaaccgagctacatcacataaacatttatattctatttgattgtgtgaatctcaccaatctggaagtcataaaataagccaattatatataatatagtttatatatataatatataatatatataatatataatatatgttatatataatatataatatataatatatgttatatataatatataatatatataatatataatatatattatatgtttaatatatttatatgtttaaatatatgtataaacatatatgtataaattatgtataaatatacataaaatatacataaaatatgtatattatgtatatttatgtatatgtatcattatgtataaaatatgtataaatatgtgtataaacatttatatggataaattatgtataaacatatttatatgtataaatatgtttaatatatataatacatattaaatatatatattatataatatataaatttatattatatattaaatatataatatacaatatatattatatattatatatattatataatatacaatatatattatatattatatatattatataatatacaatatatattatatattatatatattatataatatacaaatatatattatatattatatataatatataatatacaaatatatattatatattatatatattatataatatacaaatatatattatatattaaatatatataatatataatatacaaatatatattatatattaaatatatatattatataatatataaatatattatataaatatatgtaaatgtatataatatgtattatatattatatataatatcctatatattatatataatattctatatagtatatataatattctgtatagtatatacaatctgcatagtatatataatattctatatagtatatatataatagtctatatatatattagaatgtgcatttaacttgaaaaggttgaaactctaaagtactccccagataactggtggtgaattgggagccagatgatgaagtggcagcagaaagtacagctgaccatgagtacagggtctagaagaatattgtaatacatctacatctcttcaagaacacaacaagttggcgttatttagcaggagggcaggatattccatggtctccaaatcttggaggtcctttctgcactggattacaattctgaaactcatcatccatatttagaaaagtggagacagtgaattacattttacagggattttacccaaaaatggttaaaatgacaaagtctctgtgcttcagtatattagccttcataattttcaacacccaacatttagttttttatctcattcccaggatgacatgtttgactgaagtatctaagacacctttaggggtagactaaacttctgccactctctcccaacaaaatatctgtgtcatatgaatgttgtaggcctgccattgtaaaagagaaagtaatcaagactttaatgggattatttttaattgtcttcttgcatataaaaatgaaatgacaggttctgaaaggaaacttggcatttgggaaagagggtggaaaaaccagacaaatgtaattatcctaaactgttttaaggtacatttttcctatgctcatgtaagaattaaaattagtgttttaaagaataagttactggtaaatcgcatggcaaaagaacatacatgttcattttttcttccttatttcaattttctgagaaaatttaagtagttatttctcaggtgagttttaaaattcatccttagagattggaaactcaagggccacgcattgagacttacacatttattataataaaatatgcttctggcatattaacttttactaccatgttgtcaaacttagaaatattgcagtggaagcaaaaccaagaaaatggctatcggtatgttctttgatgaatgaaggtgtgtacacatagattgaacaaattttttacactaatttatataatgtttagccctttaatgccaaatattacacatttaatgttgtcttattacgagcactcattccggagtacaaaaaattgagaggaaaaacaaaagagacttctcttcgctattgtaactccatgctggtttggttggtgcaggtgtttgggtgatggccaccattttggtcttgtcagttacttaaggctgtagacaataaaggttgcattcctgaaataaagagttggttctctaatcttgtggaaagaaccagtattcattttctaccaggaagcaaaatgccaaggtcacagggacagaaaatattgcttcccaagaaactgtggttgacaagatggctcgagttcaagtgaatcctgaaagtatcagtttccaaggagacctgtggccccacccagccacctacaaagcttagccatcgtttcactcagagcagcagccatttcttgcaaactggcagctcatttctggatactcaataggatgcataagaatgataaatttttttcaaatcatgtgcgctagctctgttgaccttcagctgtgctgcgccttctttaattggcataaatcttggactgcccattggatgtctttctggaatctgatgtctttctgtctatctgattcctaagaggaagtgaaatattcaattaaatagtttcgttgagtccttgtagtgctaggatctttacaagagcggtttagtaggtgttgagatagactatctatcagcttcccttcccaggagaacgtgtcctgttagaaattgcatcttttgtggccagtaggggtctgtttaattgactgaaatagtaatgacccggaggaattaagacagtttttagaaacatcttatattgagaaggaagaacaataactatgataaaattatacaaatacacaataataataaatacacataatttaaagattacaattgtgggccgggcacggtggctcacgcctgtaatcccagcactttgggaggccgaggcgggcggatcacgacgtcaggagattgagaccatcctggctaacatgatgaaaccctgtctctactaaaaatacaaaaccaaattagttggtcaaggtgttgggcgcctgtagtcccagctactcgggaggctgaggcaggagaatggtgtgaacctgggaggcagagcttgcagtgagctgagatcacgccactgcactccagcctgagcaacagagtgagactgtgtctcaaaaacaaaaaacaaaaaacaaaaccaaaaaaacaagattacagttatgacaggtattttgacccctaactatgtgtcagcactctgtatagcttatctcagtactaacactaacacccatatgatgataccagagcttttaaccccattttctgaaatacagaaactaaagaacagataagttgctgcgaaaagccatataaatattaagtggtagagtcaggattttaaacagggtacactggtttctttcttaatgtattttgatccacatctacaggtgaaattcaaatgcagcttattgaattttctctcaaatattatggtgaattattttattatcttagtgtttcagatacgccttttgccacatttcctcaagaagttgatatactattaagaactaggctatatttttaattttttgttaatttaaatccttcatagaggccgggcatagtggctcacatctgtaatcccagaacttggggaggccgaggtgggcggatcactggaggccaggagtgtgagaccagcctggccaacatggtcaaaccccatgtctgctaaaaatgcagaaattagccaggcatagagcaggcacctgtaatcccaggtacttgggaggctgaggcaggagaatagcgtgaacccgggaagcggagattgcagtgagctgtgatcatgccactgcactccagcctcagcgacagagtaagactccattgccaaataaataaataaataaataaataaatactactttatagagccagtgtgggaagtaggtacattggggtatatcacatataggaaacactgggcaaatacttgtgaccctctagaaaggaataaaaaaactccttctgaaggatacaagttccagttctggtttttccttcagttggccttgaaccagaatacgttctctgggcctctctgactagtccctgtcatgttctagccccatcttaggattaaggccaagacccaaaacaagcaacatgaacatcagaacagcaccagaaaccccaggtaggcttcgcagatgaaaataatgactgtggcagccatgctactcaaatggaaggcctgctttctttttagaaggaacctaattggcaagtaagttgctatctgacttgatgggcgtaaactcaccgttctgcatcccactttcccgatcttcacttcagttgcttaaatggagtgcactaaacctcaatttgataattgcatcctcaaaacctttaatgaaggtgcctatcaaagtgtaaataattaccccgtaatcttgtatttgcaaactgcatcttggctgtttacgcttcaccgaggttcaaatcagaggttcagggcttccccagccctcacattcctgttgacgtcagaggaatttcaaggacctagaggacagcattgtaacacggttcaaccaaggcgttcaccttcactccctcccaacgctgacatctgtcattttctggtgctatttataaatccaagggagcattgctgttttgttttggtgctggtgatgcagacactcatcctcattagaatttttgccctgacgccgggcacggtggcccacacctgtaatcccagcactttgggaggccgaggcgggcagatcgcttgagcccaggagtttaagacaagaccaggcaacaaagtgaaaccccgtctctactagaaatacaaaagttagctgggtgtgatggtgggtgcctgtaatcccagctactcaagaggctgagacgggagaatcacttgaacctgggaggcggaggttgcagtgagctgagatggcaccaccgcaattcagcctgggtgacagagcaggactccgtctcaaaaaaaaaaaaaaaaaaaaaaaaaaaaaaaaaaaaaaaaaaaataggttctgccctgagcctttcaggcctggccttgttgctctgggacttgctccctcctcgctaacgtgtttccttctttggagattacccactttagctcacctggggaacacacacaccactgacccagttagggcttcttccagcctcttctcttttttccattcttttgactgcgttaattattcacaggaacccgtcaatgaaagcaccagggattatccaggaggctgaccaccaaattagaacaagaaaatacttgaaacagtttgcatgctgtctgagggtgcagctacggagagggtatgttttaggtgctggggtctgagagaaatgaaaagagacgccaagccaggtgactgacagaaggcaggcgacaaacccaggcttcccaggctcgtactttctcttcggtgctgtatttttcagcacacaaacttgctgagagtttgcagctgacatctcgagaagtattcttcttaaaagctgagcgaaaattattcacctcatgtgaaaacaagtgcgatttacatctaatgtgggtaattacttttacagttaattaaaagcgctctcattaaactcccgctgtgatgccaatgcatagctcttatttgcaaacagacctttggtttgagctcacctggtgacaggagactcctacctgaaacagggatgccgttctcggtactatgtttaattgtgctgagccagcaaccctcgagttacccggccttttaccccacgccagctctgcttgtctgcatggctagattttgagatatggaagcctcttgtcct

SEQ ID NO: 66 - DNA, 96443 bp, Homo sapiens
aattatttttgacccatagtgttgctgtttttcatcctttgtcatccttagcagtttggaccatacatttcatgcacaatggttgaatgataattaaagctaccagttattgaatttgtattatgtgttatatacagttacttgtaagggagtcttagggttattatcacttaattcttaaccctacaaaacagattcctatatatttccagtgtgagaaacacatctcagaaatgttaaagtatcaagccactacaccattaaaaaacaatagtgatgagattcagtgccaggtttatctgcccatgttcatgatctctttgctggaaggcactcctggatttggctagaagtccagtcatggcctctacccttgtagctgttttaaatatggtgtctctttacatctaaccagggctatcacctgggtctgtggtgctttcctctcttccctattactaagttttgctacctgacatgttttgtccccaaattggaaaactagtctagtctttgatactgttttattttaaaaaatttcattgaggtgtattccacataactgatatcaattatttttaagtgaacaattcagtggcacatagtgcattaatgttgtgcaactaccacctttatctagttccaaaacattttcattatcccaaaaagaaatcccatgcctattaatcagatgcttttcatttctctctccccccaaccgctggtaaccactggtcggtctgtcacaatggatgtgtccgtttatgatatcttacataaatcgtacaacacgtggcctttttcatctgacttctttcagcataatgtttgcaagattaattcacatgatagcctgtatcagtgcttcatcaatttttatggctgaataatattccactgtagaaatgaaccaattttttcattgatagacatttgggttgtttccattttctagctgttgtgaatgatgctgttatgaacatgaaggtgcaggcacttgtctgttttcaatttttgtgggtatatacctaggcatgaaattgctaggtcatatggtttaaccctttgaggaaactctgtttttcacagctctagtttctgatgtgattgcctctactgtttggggatggatgatacttcgctgacataccttctacatgaccaaatagggagcatggttgtatagacttgacaagtgatcatcatactgagactactgccagtgaaatggttgcgtgtgatttttctgcagctactgggggagacagactgagaaaggatacagggaagcaaaacgggagctcgtgtgccaagtcgaggcattgtaagaggggagaatgatggatggttggatgacagtcagtttgaaatgctggtatggcagatttcccttgagtatcaatgctcagtagtcccactttctgccttttccattctatcaccattattctttgttggacatgcacattcttcaatgcctgttgactctcagccattctgtggtctgttactgtcacttgcaagaatttggctgtcaggggagatgccagcaagtcttttaaaagccactgcaaactttcattgctaacttgtaacttggaggaactttcagagaaagggttataaataaaacacatgcatcaatctgagtttcacaacaggaatgcaattccacttcgtggctagagataaaacatgtcttgccgtgcacagtgagctcttcgccgtgcttgcattttatttcccatcacaatctaagttatggcagatgaagctgctcataaggtatgaggttagacaaccccatgctaattcacttttacacgctatggtgtgtttttaaagatccaagctctgctttcttcagcaactcaggcttgaaggaagggagaggggtggaaaagaacccagaagaacctatgggacaagcgcgagtatggtctgactctccaaccaggttaagccttttgagagcaatagctgaatcttagatctctttgtgccttaaaatgcctggaacagtgattcacataaagggcatgcattaatattaacaagtgcgtgctgctgcagcagaggatagttctgataaccattagagttcatggacaaaaaacgatgatccctaacagcttctcaacgtgtagatactttgcttagtactgtatgtgcattattctgatgtcatgtttgttattggcatgtgtgttgaatacaattatttccattttacagatgggagactgagcatcagagggtcatagccattttatgaagcctgtatttgatagaagccaggaccatctcagccccaaagtgattagggagcctgtgttccttcttaagcattaagcattctacttcactgacctcttggcccatctgaaattgttttgttttcttttttttttttcttttttttccccagaaagagtcttgctctgtcaccgtggctggagtgcaatggcatgatcttgactcactgcaacctccacctcttggattcaagtgattctcctgcctcagcctcccaagtagctagtattatatatgtgcgccaccacacctggctaatttttgtatttttaatagagatggggttttgccatgttggccacgctagtctcaaactactggtctcaggtcatctgtatgcctcagtctcccaaagtgctggtattacaggagggagccactgtgtctggccaccacatgaaattcttataagggagtatattatcttcttccttccttgaatattccaccagttttcctcccttgattttgaatctccctattcttgatttcttagggtcagtggaaatcattcttcttccctttttcattcatttgttcattcattcattcaatatttaccaccaattgaaattttgaatgttaaatatcagccactgttctagttgttgcagataggaaaactaataataggagattcctacctctggggacctagccaggtaatcagagaaatagagggctctgtgctgtgggctggggttgaggggattacagattgctgcaaaaaggagcatgctggagttacacgtaagaaatcagtgtaagaaacggtgtcctggaagaggtggcatctggtccaaatcttgaaggatgggtatgagctggccccatgaatgaaagtgtggagaaagtgtagagttctccattatctggatttccatatctttgtctacaccttgtattttgtagtaatggaatggtgaagaggagtttccagaatgtaaatagttatttggctaggcgctgttgctggcgcctgtaatcccagcactttgggaggccagggcgggtggatcacctgaggtcaggagttcgagaccagtctggccaacatggcgaaactccatctccactaaaaatacaaaaattagccagatgtggtggttggtacctgtaatcccggctactcatggaggctgcggtaggagagtcacttgaaccagagaggcacaggttgcattgagctgagatcatgctacagcatgctccaatctgggcaacagagcgagattccatgtcaaagactgtaaacagttatcttactgtcaaggcaactcaagatgttctattgctttaaatagaaaatggtagtggtgttttgtagtaaattctatatttcattttttaaaaattaacatgttgagtatatctcctatttttcttaataataatcataataaatactaatacaagtctgtaagttaaaggtgtgctgttttgtcaacagattactctgaagagaaaatccattccttatcaaaagaggttcttggattcatcactcactaccttgaaataataatgtttttcttgtatatactctctgttttacttttctttgaaaaagtccaaaagctttctttaaaaacttttctggaagaaaacatttaaaaggaattaaatatatttttaaatttgtaataacatgtcaaagataatacatgtggattggaaagaaacactattaacatttcaaaagtgaaataattgaaagtggtattgttgggttcctgccatcttccctagaggcaaccattggtacatgattaagtgcatccttctacactgaggatttcttttttctttctttcttggtttttttttttttttttttttttttttttttgagacggcgtctggctctgtcacccaggctggaatgcagtggcatgatctttgctcactgcaacccctgtcaccctggttcaaacaattctcctgcctcagcctcccaagtagctaggattaacaacctcactcagcacccttggcgttgctggtcagatgatcctttcttgtgggggggctgacgtgttttgggaggctgcttagcaattaacctcactgccctctagctactagataccaatgccacaccccttccctactctagatgccaaaaatgtctgtagatattgcccatgttcccctggggacaaaaatggctggtgttgagaatcagtcttctagatatttttaaatacacacttaaaattcacgaattaacggaaaagccagagattattcagcaaggcagggatgatttgaaaagggaaaggaaaaataacgacaggaaaagggagttgtgtgtttagaacaaacaagctgagaacacaaaatgaatctcactttttgaacagtcttttgatattgaaggtccaggtacctacgcacgtgtgaagcatttttgagttccattttctcttccttttagaaactgcaacatcctctccctgggagtgggtatttattcaccgcttcactgcagaaagcaggagtcttggataggtaacacaaggaaagaacctagtagcagatgaagaggaaagggagggaggcagggcagtcgatgccagggacacgtgtaacggggtcctgaagacacgcagctaatgaaaggtaagggtggagacagaggcagcgatcctgcacaggaacttgcatcttccatccggaaggaggaatgaatatccttggggagccttctgatgtaggtggcagcaagactttaggaatcgtgtgactttaaattcaaatcctggttgtaccgcagggtgctcatcctttaacgatacgagtttccatgtctgcaaaaatgttgaaccttctttacattttgggtaggccgaccacatcgtggtgatgtgcagaggtggtccacgttcattgcccaggtcccccacgttcattgcccaggtctcccgctagctgtttatttcatcttggtcatgccgtctcacttctccctaccccagttttctcatctggagaagacaggactcatcgtcgccacgtaggttgtatgtattgagtcagtcgacgcatgtaagagcttagaacagactgagtgtggtgccttgtacctgtaatcccagcactttggggaggccgaagcgagaaaatcgtttgagtccaggagttcaagaccagcctaggcaacatggggagacccccttcttatttacagaaaaagggaggggtgcttagaacactgcctggtacatagtaaatactccagagttgctcgctgggatcattagcactcaagtaattcccatgggttgttaagaggcttagagatgagaaaataacctagaacagtgcctggtatacaataagcgttccataagtggcagtgtgggcacagtcttccgggcatacgtgcttgcgggcatgcgtgctctcacgtgctctattcctcctctctttggtccctctccctcttgacattttcctttcttttttttaaaaaccttcctttttttctttgtttgctaccagcctaagagctcaggagagaggactaaccctaagaccaggtgatttatttttctcacgctcatttctctttaataattatcatattgactctgaatttattatactacaagaatgactttatgtgaaatctcatgaatttaaacattaatgtaagataaattaattttaaattgaaatcctcaaacgcagttggatgtgtttccgtatgatgaataagaaattttccgaataaaatctgaatctctgatgttccattttttgtgcaaatggaagaaataggtgaggatatttgacaaggttaaaatatgattgcactgcaatagataggccatgctgtaaactaactttttagtctggggagaaagcagtttgggggcaggctttggtggataaaaagtgaagatttctttgcacatacttaccgagtctcttagtgtcctttaatctaacaccagtgaatataagatataccatcctaaagaggacactattttttacatttttaaaaataaatccattgtattagaggtgtgtttttttttttcttcaactactttaatctcattttctcctaaagttcttctcttcaatatgatctgcaaagggttgaaagtgctgtcctccaaaccaggcgtaagaaagtggttacagataaagcaagtaaatccattaaagaagaaatgggaagatgtgttgtgtgccttatctgacccagcattatcgctggaggggaagtgcttatagggaaggaagagaagtttggtcaattgatgcagtctcagtatgatgacagctggtgacttcctgagggttattcatcacacttcagcagggtgatgttttcaaagcctgagtgtgaccatgtcactcctctgttctccagcgctttcaaaataaaactgaaatccgtctcagagggccagtctcagagtatcccctgccagccccatccttcactgctcagcagtcacctccttccccctcctcacccttttgaggtctcttctgatccttcaggggccagcttctctccgtcccatggttgtttgcccatgctgatcccctacatggatctccggtcacctccatcactcttacctggttagtctttccctggcctttatcccaggtcagcttcgcttctgcaggaatgcctgccttgaaacctcaggtccttctgttccccctcttagagcactgggctattctcctgggaggcagtaattccagtagtaatttgcatacatttgtaagcagttttgattaatgcctgttgtttccactagactctatgctctgtaggggacaaatcttgtctgctttttgctcatcaatttttccccagcacagagctcaatactggcactggtaaacccttgagaaaatgattaaaagcctctaagatgcatgcagttatgaagaaccaacagaaggtacaggtggcatgggacagcagtcaggaagcaatttggcttaaggaggaaggccagtgactcacagatggagtctcagcacttcccttgcccgtagaagtgagaaacaatacaggtagtcacagcatagtaaaaatttcaggccaggcacagtggctcacagctgtaatcccagcactttgggaggctgatgtgggtgggtcacaaggtgaagagatcaggagcatcgtggccaacatgatgaaaccccatctctactcaaaatacaaaaattaactgggcatggtgacacaggcctttagacccagctactcaggagactgaggcaggagaatcacttgaacccaggaggaagaggttgcagtcagtcgacatcacgccattgcactccagcctggcaacagagcgagacgtgtctttaaaaaaaaaaaaaatcagatagcagtttcatatgactagaggctgtgggctgatcagatcctgaaaaaccgggcatggaccaagctggctaagaccaagtggacccaacatggtgctgaatttgacctaggattcacctaggacctcatgatgtgtttgttaacatcctaagtcactgtgacttgggatgttaatgagtgacttaccatgttaatgagcatatcacgaggtcctaggtgaccagcaccatgaattccgagaatacctacgtttggtgtaaaaatggatggcatcacaattctaagaaatttccaccctttcccaggaattttcataagtattccaccccttggctaaagaaacacataaaggtagcagccccaaatccccttaggcatggtgctctcttgagtccgcctacactccccctttcttgagtgtgtacttttcccgttgttataaatctctgtacttccactgttgcctgactcatccttgaattccttcttgagacggtgtcaagagcctggacacctgccgggatcagggtcccaccagcatttggggacctccccaagcccactagtatcagtagagtccctataggtaattgtctaataagtggaaggtgggtgtagaagtttcaagaaaccaaagaaatgtcagatgtgtcatttgacccaaaagaaaagcattttaaaggaagttaatgaaatgcagtcagaaaaaaaaaaaaaatagcataaaaggagaaatctgagaagttctacttttaggaatttaatctacataaatacatatataaggaggcaagaatatgtgaggaagtaaattcaatgtgtacacacacatacatacacagacacacatagatatatagaacgattgtaaaaggctatttgtagatttcttgggtaagttttgggtctgtccatgcaatgaaataccactcaaccattaaaaaaaaaaaaaacaaaaaaacgttaacttataggtacttagtatgacaaaataagtaccattagttaaacaaaaacaggtatttgcataatcatgtgagtaatatgaatgtattttcttttttcttttgtttttttaagacggagtctcgctctgtcacccatacggcagtgcaggggcgtgatcttggctcactacaacctccgtctcctgggttcaagagattcttctgtctcagcctcctgagtagctggaattacaggcacctgccacaacacccagctaatttttgcatttgtagtagaaataggatttcgccacgttggccaggctggtatcgaattcttgaccttaggagatctgcctgccttggcctcccaaagtgctgggattacaggtgtaaaccaccatgcccagccctttatttttattttattttttttatttttttgagatggagttttgctcttgttgcccaggctggagtgcagtggtgcagtctcagctctctgccacctccgccttctgggttcaagtgattctcatgcctcagcctcccaagtaactaggattacaggcacacaccaccaagcctggctaatttttgtatttttaatggagacaaggttttaccatgttggccaggctggtcttgaattcctgacctcaggtgatctgcccacctaagcctcccaaagtgctgggattacaggtgtgagccaccatgcctggctgaatgtattttcttaatgtgtgtgaagacatcagtatctaagaaaagattgtgcattctgatatacacaacagggaaagtctaaaataatacagaactattattcctggttagttcctaacattgtttcataagaaaatattccactttttttttccagtttatctttgaattttactaacgggaagtaataatagatcaatgaagaaaaatgtcacagggaccgtaagaggaagaccttagaaaaataagcaggataaaagcatcctctatgccaggagttctcaactgagactgttttgttcccccaggggacagctggcaatatctggaggcattctggtttgtcagaatggggtggggaaattgatgttgacatctagttggtagaggccaagggttctgctaaacataccacagtatatagaacagctcttacacaaagacttccccaagccaaaatagcaacagtgtcttggttaagaaacgttgctctatcatggttaaaatatggttctctactctttgcattctggtaattttaggaggatgacgtcctctgttgagatggtaaggggtcgagagagtcatccagataaaatcggtgttgactttacaatatctgaatcactcataaaattattcaagatagtaactctcccacctcctggtcaggttgacatttcagcaaccaggtagaattggtcatatagcctgttgtgaatccatggatattttatttaattgcgatatgtaaagttctccaaatgtggatgccatagaaccttcggatttaccatctaagccttttcccaattgatctcactctttttgctctaatcaaatgtacctcaacctccatctaaagtaaagctggatagattcatactactccattatcactaaggttcattttatttgcaagcggttttgctcattataatttcattagcatatttggaggtggggaatgagagaggagacaacacagcttagtcttaccttaaaccttggcttgacttggtcgaattttaactctattcttggctcacccaggtcttatagtccaagatgtaaatttacagaaacaacttcttggactctcctgttttttccaatgtcttattagatgatacgtattttctagattttactgagttaacatattttagttgtgttacctatgcaaaaaacaggaatactctgaaacatatttaaccacataattatacctcagcaaaccctccaaccaaatgcccattatatatcatttacttagcctaatatatttccctttttgaatataagagatttcacctctgaacattacatctaaagatgggcaactgtttaattatttgagtaactcaaaaatattttcaacaagagccagggctgtgggaagtgtcctcaaatggaagggttttaagcattttttttaatacaaagatgataacttgcaaccagttctattatttttaactctttgccccttcctccatctcttgggtttgagaagagctggatctttgggcaattatttattccatttccacatctttgggaaggagggacagtgggaagaacaagacccagcacttggggaatttttatgattatctccagctgtgaatgctagggagcatcatttatgcagtgaaagaagtaggaaaagcaatgtcttacttctgacgaagaacttacagttctctctaaaggggtggaataaaattgctattgcaaaaacgggaagatgttgctaatgggaatataccgaatggtatcactaattaaataaagtactttggaattcattgacagcctgcacttaagaatataattgcatattaatcaaccatttgtagacaaaactgaatgctatttattatgttaggataaaactttttcctgatatttcaaagcctgcgattcaactttgttcctaaattcatcttcagaaatgaatacactgtatttgtatgtgaggagcccaagtgaataaataagcaggagtttctgaagggaacaacacagtgggatttatcttgaaaagagcaattgctgacatatgtcacatgtcattaccagagagttggagacagtgttactcattatgtggttacagagtgttctaaattagagaaatggattattggtagtggatgatttccccagattgctacttaatagtgactgaggggtctgcattactcatatttgcgatgaaaatggtgccaaaacccagcagtggttgactgaaatgaaatgtaacacctattgggtattatcttgagatgctgcctaattgtatgcctcttgcttagtatgaatgtcttggggtctcaggggctgggtgcttgcagcagccgcagacggaaagtgaaggtttctaagttatttacctttttgttgcttcctgcctccttgctgccatgcctgtgcacttcagtaattactttacccactcaaaataagtttctccacttgccctttttccattactgggaagggtctatctttgcagctctctgtaactgtccctacctgtttgagctgccaggcttgtgctcctaggtgagcagcccagctactgttttcattcatttattgattaaatagttaagaatcccaactacgtatcaaagcctgtgctagaccttggttctggattgacaggcgaactagtgtatctgcatttctgcagctttcaatctctggggagacagatattaaaaatacagtcacacaaattgatatgtaactcctgctcctcatttaccactaatgttctaactcagcactagtcctacaggcctcttttctcttattcaaatatttcaggctcttttccacctcatggtctttgaactcactcctctttctggaaggctttttctgtggcactttccttttttttcaagtcttgtattttattttattttattttatttttatttatttatttactgagacggggtctttttctgtcacccagggtggagtgcagtggtaaaatctcggctcattacaacctccgcctcccagattgaagagattctcctgcctcagcctcctgagtacctgcgactataggctcccaacaccatgcctggctaattttttgtatttttagtagagacagggtttcaccatgttggttccgctgttctcaaactcctgacctcaggtgatcaacctgcctcggcttcccaaagtgttggggttacaggtgtgaaccactgctcccagcctcaagctttattttagctcccaccttctcagggagaccctccttgacttcccagactggaatgccagcctggccagctactctctgacagtctgaccgatcatttcctccactgcacttatacacctgttagtatgttgttaaagttacatgtcacagggcagagattttgtcttcctcatgtcttcccattggcacctagaattgactggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggagaattgtttgaacccaggaggcagatgttgcagtgagctgagatcatgccattgcactccagcctgggtgacagagtgagactctctctaaaaaaaaaaaaaaaaaaaaaaaaaaaaagaagaagaagaaagaaaaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaacca

SEQ ID NO: 67 - DNA, 15943 bp, Homo sapiens
ctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggta

SEQ ID NO: 68 - DNA, 11498 bp, Homo sapiens
gcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggta

SEQ ID NO: 69 - DNA, 2902 bp, Homo sapiens
atccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgttt

SEQ ID NO: 70 - DNA, 1545 bp, Homo sapiens
ctctgtgtgaaattccaaggatacctttctccaaattaagcaaatgctggaagttagtaataggagtacaaacagaccaactaacccatttgggaagtatatataaggtcatctggaaagatttacagttgccatttgctcatttaaaatgtagtgaggtgttttaaagagggtttgttcaatttaccaaaaagggaaaaaaagggaaaagaagaaacttattgttgaacgaacacacacacacacacacacacacaaagagcctggcttaatttagggataaagcaaagaagtcaatacccccacatcaactattgaaacctaagctattgctggagttgacagcgatgattcaaagctaagtttaggaaccacagtgactctccctctgtgtgatttggggtaagatttagttcttctttctgggcctgagtgtcctcacctaaacaacaggtataataatacctgccatccaccattacacagaaacctaccataggacctggtacatacagagttgcttaatatataacatttctctttcttcttgatacagttatagcagtacatctgaaaatctgaaagacatacccatcataggccccactgacaatcctcttgttatcaaaccggatgcatcggaccaattcttcatgtccctctaggactcttaaacaggcaccacattcaatatcccagagccttgaatgaaaaacagacctctgtgaaacaaattcccacacacgattcacactatccgtaagttttttatatctgttccatacagatacaatttttcactatcttggagctctttatttctatctcacttccagtacacaccacacatataaagctgtatgtgtacatttataccatctgtgtgtttccaagcactaacctaggaagaagccttactttttattctatttccttttatatgatttgaaactgtttttaatcatgcgtctgtattactatttaaataaaatcaacaaacaagaaacttcaattctatttaatccttaggcattctcttgatgtctgagttgataaaaaccatgtagacaaatggtgtaggaaagactcttctggggagacagggattgtaggcagtaaaggagaaagagcacagatgagacaaggtgggaaaggagatatcacgtacagccagggggttaagcttccgccccaggcacttctagcacagtggagtccataaggaccactgaggttagaactggcggaccagcaggggaggtggctgtctcttgatgaggcttggggataccccttccttgatactatatgctgaatactgggattgacggtttacaaagtcagagtgggagacttactaggtacacgcagtgttctggtggaaatataaacccattgacaacaccaagtctttttctctgcatatgatttatgtaacaattctggagttagagatcttttttcctattatgactgattttctacagtatttgtagaaaaaaatcatagctagttagcatgtacaaaataaagtgagcaaattaa

SEQ ID NO: 71 - DNA, 3210 bp, Homo sapiens
acagaaaacaccaagagtttaagtagcaaatatactcactttggaagtagaaatagccttttgatataagatagtaattctcatttgctcttccaaatttattccctcattcgactgggcaactgcttggcaagcactgtgatagatgctgttatggattgcatatgtcctccaaaaagcatgtgttggaaacttaatcccaaatctaacagtgctgggaggtggggcttaatggtaagtgtttaggtcatgagggctccactctcatgaatggattaatgccaattataaaagggtttcaggctgcaagttcaatctcttgctctatcaagcaaagctctctcacgcccttccatcttctgctgggataatgcagcaagaaggcccttttgagattcaggtcccttaaccttggacttcccagcctccaggtgagctctaagacataaatctctgggccgggtgtggtcgttcacgcctgtaaccccagcaatttgggagcccaaggcaggtggatcacctgaggtcaggaatttgagactagcctgaccaacacagtgaaatcccatctctactaaaaacacaaaattagccaggtgtggtggtgcatgtctgtaatcccagctacctgggaggctaaggcaggagagtcgcttgaacctaggaggcagaggttgaagagagccaaaatggtgcagcctgggcaacaagagtaaaactccaactcaaaaaaaaaaaaagaaatctctggccaggcagggtggctcacgcctgtaatcccagcaatttaggaggatgagacaggaagatcacttgagcccaggagtttaagaccagcctgggcaacatagggagaccccaccttcacagaaaatttaaaaattagtcgggtatggtggcacgtgtggatcgcttgaaccctgcctagaaaggtgaggctgtagtgagccatgactgcaccactgcactccagcctgggcaacagagcaagaccatgtctcaaaaaaaaaaaaaaaagaaagaaagaaaagaaaaaagaaagaggaagagaaagaaatctctgttctttataaattacccagtctcaggtattttgttatagcagcacaaaacaaactaagacagatgctgggaatgaatatgccatgaactgaagatgacaaaacagatatgatcctcgcccccatggagattactttctaataagagctgattgtctagcaggggattacgcaatacatttgtgtatcagtccgtttcatgctgccaataaagacatacctgagactgggcaagttacaaaagaaagaagtttaactggacttacagttccacatggatggggaggcctcataatcatggcagaaagcaaggaggagcaggtcacatcttaagtagaatggcagcaagcaaagagagagaagcttgtgcagggaaactcccctttttaagaaagatcagatctcgtgagacttattcactatcacgagaacagcatgggaaagacctgctcccatgattcaatcacctcccacggggtccctcccacaacacatgggaattcaagatgaaatatgggtagggatacagccaaaccatatcaatttgtaaactacagttacattaacagctgtaaaaataaaaaaagaactgactgctgctagagcatgacaagggaacttaatctataagggtacctaggggacccaggcatggctcctaaggagttgacacttcagctcaactctaaaggacaagcagaggttaactagacaaggaagaaagggtgacccctccctaataatgagaacaaattataatgcttgttgtaaccctcaagcaggttcagaggaacagagaaaaagaaaaaaaaatcactgtgactcaagtgcagaaagcgagggtgaaaaagagcaaaaatagacaagactcaggaggaaaacagaggtgtcaaagttggggttactgactgatgcaaccaaaatcatcaaaggaatatcaaagtaaaagacaaactacattggcacttgaaacctgtccagtggtgccctccacatatataagttttttcaaggtatttctataaacataatacaggaaaaaactggacgagaaatagggttcagtgcatattaagaaataaaagcccacctgagaaggggaaggaattcccaacagaaccccacctcaaagcagcaaaggctagtagtaggagtgagagtccttgaagctgtcagtgaagccaacagcaactgatcctaaagtgtctcacagagagcatccagagccagagtctacgcagagaagggacccaatttccatttgccatggacagtatgcagagtgaggcaaacacttccacagctggcttttaacaaaaatggccatttcaatcacaaaagggcagcagcagtgccccagtcacgacaaaatcagaagttcctcaccctagtgatttccttccgctacactcccccatgcacctagaagcagcagagcagaactacagctaattttaacacttctctttcttcacaaaagaaatacgaatagccacaaacattagaaaaatacatccaatgtcactagtaacttaaatctttaaatctttaattaaactgagattttttgatttattaaaaccctaaaatggcataaacatgaagaaagcatgtttcatgcagagaatatagtctgtcatgtcacatcatgttcataaaggttaagaacagtgggtaaaacctttggctatatgaaatactcatgctcttaaaaaaagttagagaccatcctgtgcaacatagggagaccccattttgtctctacaaaaaccctatattttgtctctacaaaacttcaaaaattagccagtcatggtgttgcatgcctgtagtcccagctactcagtcaactgaggtggatcacttgagcctgggaggtcaaggtatgagccacaatcatgctactgcattccagcctgggaaacaaagaccctctctcaaaaaataaatatatacatacataatacatacatacatacatacatatgtacatgtatatgtatagatgaaggaagggaagaatacataccatatattaatagtagttataatggaaactttgttctttttccatcttactttacgtttttcattacatttttccatcttattttacattatatttattttcattttttctataataaat

SEQ ID NO: 72 - DNA, 3120 bp, Homo sapiens
gagttgtggaagagttttgctattaaaatgtgttttctcatgaattgccttgttctgtccactcacatcccatatcaggtagttgggagctatgttgttcccactgattatattcaaaaacagaggtcacatgcagttacgtgactgtatgcttttcccaagcacaggtgtcgcaaaatggttagacaactgagattttagttgaggtatattgattaccaatctgatgctattgtcacctgaacacacaccccttagcatggtacccaaggccctctcccacctcagggttgggggggatctgttcagtcctctgtcactcggtgctccatctgcaaccccaaggatgttcagggatgcctgtgaggtgagctgggctggtgcccagagactgagggcttggaagaaatccaagaggcccgagggtagcaaggttaaatacagtgcactgagctttatctaggctctccttttccttgtgtcttgatttcccgtgggagccacagcctttctgtgtggtagtccattctcttgtactattggttaactatggaagtcagtgatgaagccaccagcctcttcaggccctgtgtgccatgtggccacgttagagaccaaatgcatcccagaaacactaagtgggatctgaacctcagcccctaatgtctcactggtctgacctgtgagatacctcaatacctgccctaagcagaagagcctgctgggcactgggttcaaagcctggctccaccacttactatctgggggaccctggatgaggtacgtaaactctgtaggccttcttttccttgtctgtaaagtgaggtcaatgatagtgcctgcctcaagggattcctatgaggataagagttcatgtaagcaaagcctttagcacaacactggcatcaaatatacaatctggaattgcatgctgcttctggtcatctctgtggtgctccatttccttcactgtaaaatgtgggtcatgacagtatctacctcgtgggactgttgtcaggaataaacagagtctatccacctaagtccttagcattgtggccaggttcttagcgaatgctcaataatgttcagttatttattagtagtatgattattattacagatcagtaattctatgaattaggatgtctctccaatcttttgtaatggcagtccacagatatcagatgcagtcaaacctccagagtaccaaacttaagtctatgtgcttccatggagctaaaggtacagatgaacctgcagttggagtccagcagtgtgtcagcctggtacccttcttaccaaaaagaccaacttgtgggtaaagaagcaaaggttccatgtggccagatgggtttacgtagccaggcctgaatgccagctgctgcttcaggaaattctaggaggcaagaaattcttgtccagcaagaagttctctttctataaaaaggcaacagaatggaaagggccaacaactttgcacgtccccccaaaagtacccaactttgagggaaggtcacatgtggtggctttgagcccagaaatgtttctttgagtacagaaacaaaatgatatttcccccatgttgttaaggggcagctggagggaggttttgttccttcctctccttctcaaagagcttcagggacacatcttcctgtttcaagagctctgaggacagtcttggtttgccatgaacttaccatgtatgtgtggatcagtcacttctgacttggcctcagtttctccatctggtaaaatgaagatgttggattacatgacatctaacatactttctagctctgacaatcaattactcagtgatttcagccatggtaagaattggaaattcatcccctggcatataaatcaaaccattaaaggaaccaggggctggttctgcaggctaaaaaaggacagctagcaatgaggttcttcactgatccacagacacgctgtgaaggctggtgagcccttgcatggacgattgtgtgtgtatccaagtggtggcagggctagctagtatttttgcctgcctagctttcttgtccctctcttctagaatagaatccattttcccttgttggaaactgctccccccacccccaccagtgaggctgtcaaccacatggccttgaaaaaggtaattgtttgcatgatccaaaaaagaatcaccaagtgtccctttaggggacagatgtagatgtagctcagagagttagtctctcctctaaaaatcaaaagtactcaaagctgttggaagtcatctttacaaccaagtggagagagcttaccagagtccaaagccaacccaatagaaagtgcagagggaaacagggagagaagaaggaggggaaagggagaagaaggggagagggagggagagacaagaaaagggagaaagaaaaagggaagagacaaaagatgagaaggaggaagagagggagggatcaggagagacagaggaagagattgagagagtgagaaagagaaaggtaaaaagagaaaggaaagaagaaaggaagaagggagacaatgacagtaacttaaatttcctaatgtgaacttctgattttctaatttgaacctctagatccagttgtacataaaggaagacttacgtctttgcctttccagttaaatgagccaatgacttccctttttacttaagtccatagggttcttcaaatggggatccatgaccctcaaaatgttagaaactgcacaattggagcatttattagagatagaatgaactcacttcagaaagaaacaaggtttatttgatgaatataaataaggcgatcagcacaaagtacttctcatacacatgacaacaaatttatgaactgtacataccttgtacattgttctactagacacgaggttacaatgactggctaatacatgcccactggtagtttccagggttccttagttttatttatttatttttcatatcgatgtccataatcacatggtcaatatcacaacccacatgccactcacttgaagaaatattacaagaagcactatcaaacgagggtctcggggaattagatacactgaccctgggcagcattcaatcgccactctacacaaaaacattgcagatagagc

SEQ ID NO: 73 - DNA, 621 bp, Homo sapiens
ggaggatcaataagatgcctaggaggactggaagaactttggacaacatttccgcggagaccggcgcgaccacctgcgcggaggtcgcggctcacgctctggccgcactgagcgcggggcggaggcttttgctgggctccaactttcactcctcccactcgccccgccccgtcccgcgctccccgccccaggcccgccccgatggaaatctccgacgacgtgacggctgctgcggtggggagccggggaggctcgcgcgggcgcgggaaggaggcgggagcccggttgctgaggccccccgtccccacgccgccactgcggcgctgccagacagccaggggcgggggaggcggagggaggaggcggcgagcccgcggcgcggggcctgggcgggggaaactcgcgccccaggctgtggccggcagggagctgcttcagggacaagatgtggggctggatgtgctcacgccccagaggcgaccccctcctgcccgctggcacgccgcggggtcaaactgtgctctccagccgtggcttcctccccgccacctgttgcaccccattgcttccccaagtgtcctggcttcaacctccctctctggttttcccagctctcagccc

SEQ ID NO: 74 - DNA, 2585 bp, Homo sapiens
cttcattctttacccttcaacctctctctcagcacagtaacctttcgttaattcaatcacccagcccctattgggctcccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccagtgcggcgcgctccgatgccgtcatcgggacccccgccccccaaaccagcccccccctcacccgcaactccgcccgccggggcgctcgggggcggaggcgcgagccggtcggcgtcgcggagtcggcccgcagacagggcgggcggggcccgtgctcaagggctgggcctggagagtgtgcagcatcctcatgatggcatcgccttattttctagaatttgtctccaaactggactccagaccatcctgtcctcagccccgagtcaccttcatccccggtctctgttttccactcccagtcccaaaccacgcctcctgcacgccactcacacagccggcagaaactttaatctccccacgtttaaaaaagttttctcagttataagactctctttttctcacattttagcattcctaaaattgagttccatcttacactcattgtcaagggaaacttggcaccaggaggggcaggagaggtgatctgggggtgtccacggcagcctcaaagagatggttggtgtcttcacctctgagacctctgatccattgtttgcactggaagcaccatgaatgggtgaattttaaaatctgaaaacatatttgtcacttaaaacgccattagaaaaagtaaactccagtgtagtttctagtgaaattttattatgtatatagaagattacctgtcatagacaggcaacataattaaaggccatagaaattgccaggctcgtcagatagatctatattaggaaaccctcagcctccagtaacagaaaccacaatttgaagtggcttgaaccataaggtcatgtgttatctcggggaacagtgaaacccagagggatgagggctcctgggcaggttgagtcagtggcaacattaccaaggaggtggcctttttaactctttttttttttttgccatcaacttcagacacaaaacgtccagaggaagaagacagcagtgtgtggtgaagcatgccctttggatcaagagcactccaagctgatttccttcccattccatgtaccacacagcttaggcctgtccacccccaaactaatcactgtcaaggggatggaactaccatgattggcttgcaataccagtgtgagacagcgtggatataggaaagtcatccacaatctccacaaccacatcctcgaagcttcatagaggagaggctggccaactgattcgtgtatcacaaaggaccatgattcaggtaccaagcatctatctgtcagatgccaggagctgtgccatttcctccaatagacaattcaattaaggagaaactaaaacctcgagcaattggaaagagcacatgaaaccccagtgttctttgacatgctgtagaatgacactgttgttcccaaatattctaaatcaattggggtcctgaacaagaacaacacagagcagcctgccgccgtgatgcccaaagagaatcattttagaccctgaaaatgtgaagaagctgaaaactgaacttggattttcatatgtgtaaaatgtaataaaaggtgatgatgattaatgaaacatcatgctttaagaggtacaattctgggccagccaaggtggctcatgcctgtaaacccatcactctaggaggctgaggcaggcagatcccttcagcccaggagtttgagaccaacctgggcaatagggcaaagctgtttccacaaaaaatgcaaaacataggcaggcgtagtggcatgggcctatagtcccagctacttgggaggttgaagtaggaagatacactggcttgagcctgggaggtggaggttgcagtgagccgagatggtgccactgcactccaacctgtgtgagagagtgagaccctgtctcaaaaaaaaaaaaaaaaaaagagagagagacagaggtacaattctaattacaattatagtaattaa

SEQ ID NO: 75 - DNA, 995 bp, Homo sapiens
cttcattctttacccttcaacctctctctcagcacagtaacctttcgttaattcaatcacccagcccctattgggctcccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccagtgcggcgcgctccgatgccgtcatcgggacccccgccccccaaaccagcccccccctcacccgcaactccgcccgccggggcgctcgggggcggaggcgcgagccggtcggcgtcgcggagtcggcccgcagacagggcgggcggggcccgtgctcaagggctgggcctggagagtgtgcagcatcctcatgatggcatcgccttattttctagaatttgtctccaaactggactccagaccatcctgtcctcagccccgagtcaccttcatccccggtctctgttttccactcccagtcccaaaccacgcctcctgcacgccactcacacagc

SEQ ID NO: 76 - DNA, 32 bp, Homo sapiens
gatgcaatcacagtaatagccgccaatcaggt

SEQ ID NO: 77 - DNA, 154167 bp, Homo sapiens
  misc_feature (15129)..(65128): n is a, c, g, or t
attgaggagagaacaggaatcacccagaaaacagactgacgaatattttgagttagaatcctgccacccatgacaagtcagctcccacccctccagagtctccagctagagcacttgcagtaagagttcagtgggcctttccaggcagccaggcatgtgctgccctccggattcattaacagggtttcttggggtcagaggaggtgccaaagccctgagagaagccaagccccagaggactcccaagttctccccgcagactcatattcctcttgtaggtgggaaagggacggagaggtgcagggggaacgccctgttccacatgccgtatttactctgggcatggctaatgactccagggccttatcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacaggtgagaagacgtccccgcactgtgttcagctgggtagtcccatgccctgcaactcagggctgctctggggtaggaaagctgatggggaggtgaagaggaggagaagctgagggcttgcgtcaatgcatggaagagactcatccagtgaccgcctgtgtatggccttaatctccagtcctcaacaagtcatcctcctgcctccacctccacggaggtgccttcccaagtcccaggggtcttcttgtgttgcaaaagagcaggaacctgcagttgtggtttgtagctcaaagcgccccaggacttccccaggggactgaccatcactgtccccaagagtttttctgtccctttaaatcagcccttcgtgatgttcatgtaaaactgtagaccgccccacatctcccattttcctagatctcaaagacctcagctccaggaggggagccatttccactctaagattctaagactctatagggcagagatgaggccgggcaggctgagtggcagagaggacgctgatcccacctgtatcctgcgtgctgtcttgcagatccccccctcccaccccatcttctctagttggcccctgagaaaatgggacgagaatggggggaagagggaggcagaagtacatctcctgcttacatgggggtttgtctccagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatgtgaggcctcctggggtcagggctggggagaggtgggagcgggaggaaggcccagcattagggcatggccagtgccacatcagtagcaccgaaggccattgtggatttcttcacttggatgatgatccatggggactgattccctgggtccccatggagttggctaagcaggcccccatgtacccaaatgtcagagttctctgcagaaggaaagggctgggagtgaaagcatcatcccacactgaaggcccctgcttctgctctcagctgggcagcttactggctgtgtacccttaggcaagttacttaacctctcccagccccagttccctggtctgtaaaacagatggttcttcctccactgcctctcctacaatgtatttataagaatcaggttagtgcaagtaaaatcaaatgaagtagccagaggcttggtttgatttcctccttcatggccatttctctgctccttttaccttttattttccagcgttgccacttcctaggctctgtaaactccagtctgtattaccccaggctctggcccctgggagctttcccctggcttcctggtgagcacccttgtccctccccaccacccacaccctctttccttctcactcttccttgcagatggaatacttcggcactatctccattggctccccaccacagaacttcactgtcatcttcgacactggctcctccaacctctgggtcccctctgtgtactgcactagcccagcctgcagtaagtggggccaggagcaccagcagagaatgtctgggggctagtcctgggaggccaagcctggtactctggggaaggggggcttaggttccagaaactggccatccctgccacaccagcttccactctccatctttgagtcagccgtggaactgcttatagcagagatagagcaaagccaaggaagaactaaaatgtggctgctgtccaagagagtaactttcatactgatcagaattaatagaaagaaagccattgaaaagagaaatctttgacataatgactcacttcctttggaacacccaaaggaatgtaggggaagtttaatttaattggttatttctgagcagggaggtgagtcgggttctagtgtagatagtctgcttgtttcaaggaggcttggtagccttatctcctggtgcacacaggtggggctggtggggcacaatggcatgggtgggtccatttgtccagaggtaactcagaagtttcagtgaggattggaaaagaagagctacagaaagatgtcttgttcgatacaggacaagtcccagagacagaatgtctctggaaaccccaaggctagagatgtccatcggttgggagaaaagttgggagtaatttcctggggcaattgtttatccctgagtttcttttgaagccaacctctgacccacaatgggtggcagggactgtggctggcgcctgataaatgacacttatcttggtgtgcctcatgaggtcattgtggacaatcaggtttgctcagggatagctatttggtccccagttaggccacatctgtagctagagggaaatgtagttgttcattagggaggggcatcaccaggcttctaggggcccccactcagtgttgagagctgagggaagagaccctgccgctgtggggctgggtggcattagggcagggatgcagccagtgagccgatggcataagcaagagcagtgcacttctttccagagacgcacagcaggttccagccttcccagtccagcacatacagccagccaggtcaatctttctccattcagtatggaaccgggagcttgtccgggatcattggagccgaccaagtctctgtgagtgcaagtccttcattttttctctcttggacagaaacttgggagacttattcagaggtcttacatttcaaatctgcctcaggaatgggtggaaacaggggttagcactaacttctaggagaaagggcaagcaacactccccacctgagatggtggcagtgggtcagtctccacagcacgctgggccctgggggagagcagcacagggggactctggcaggaagcagtgcccagtgcacaaagcctggtggcagggtgcacagctggatctccagtctctagggcattgaggagataaaaccacgtctccgtcttgaaggataaagaagtccacaccagggggagagatttggactcagtaacataagggggcaaggtctgaaatgggagtccaatcacagaggcaaggcagaagcccagttgtccaaaggccaaggtccaaactgaactcagtgctgagctcatgagctgttcctcaaactccctctgacctctgaccctctgactccctctgaagtcctatgggtcctagaactatgggaatcagacaaatgtggggacagagagccaggtactttttcaggcttatagacagcaatatatgcctgggccttgggagaaagagaggttgacctactcctggtgaacgttggtccctggggtattcccgaggccagcagggcacagccttcatcaacatcccttagagtgggtggagtaggacatattatcaactgaaagaatgccagaagcagaaaaacaccatctatgtaaaaatatcatacagataaaacaatgtactgtattttctattggaactatgtatgcgtgtgtatacacacattacatatataatatataatatataatatccatatatgaatatatgtaatatacagtatatttgtatatataatatatatccatctgtatatattatatagatacaatatgtaacatattaaagtatataataattgcataattatatcatataatacatgttatatattatataattaatataatatgtaatacattacattaatatatgttatataatatataatatattatagaatataattgatataatgtattatattaataatatagtatgtgttatataatatattaatatgttgtatgtaataatatattacataatatattatgttaatctattatataatagattaacctattatataatagattaacataatatattacataatatgttaatctattatataatagattaacacaatatatatgtaatgtgtatatattatgttatatataagattctatatatattatgacatatacatatatattatatatctaattacatataatatatatataaaagttaaaatgactattttgaaggctacatccctaactgatcatcacagtaacctctgagatgcagggaagggactgaaattagcatagaaaggggaattcaagcctatagcttgtcacgtatctgttggctcacctggctggtgtagggcagcagccaagcccacagcaatgtcagctgcattgctccttccctcagtttttctggctccaggaccaggtgtgcacttacctctaacaaatcatcagcttttgctgcataacatccccatcattgaggctggagacttggggacagtgagagaacaatgtgggttccagtccaccctcaccctcatgggttccaactggccctttttctcccacttgacatctatcttccctttctgctgtgcaaactgtagactgctgctgcagcatcaggacagaaacagtatcctaaagtacactgtttaactagcacccacagttgcatataatcaatatctatatccacatcattatagctatatctataatctatagtacctcctaatggttctgcttctcttatcaaaccctgactgacataataaagatatgacatgtgaaaatttgtagatgaagctgatgcagcccttaaagggaccatttagcctaaaatgcatgcgttgttaatagaaatgctaatgatcaattatctaagctcctatttcaagaaatgaataacaagaaaatgagcaaaccgtaaacaaacaatagcaaatcaaacccaaagaaatcaaaaggaaggaaataataaagagtagaatgggacacaaatgaaatagagaaatcacacagtacagaaaattaacaaagccaagaatgaactctttgcaaagagtaataaaattggttagcctctcacatgactaaataagaaaaaagaaagaaaatacaacttaacaatgttagaaatgagaaagagaacattagtaaagttatcaagaataattttatattgataaattttacaattttcagaaaatcaacaaatgccttgagaaatacagcataccaaaactgatgcaaaaacaaaaaatagaaaatgtgaatcttttaaagatatactctgttattaaaaaatctttccacaaagaaaactccacgaagaaaagcctcactgataaattctctcaacactaaaaaaaatcagtctttcacaaactcttccagatatttgacaaagtaaaaacactttataactcattttatgaaaccagcataactttaataatgaaacttgaaaaggacattataacaaaagaaaatataaaattacagaccaatctcttctctcatgaatatagatgcaaaagttctaaatgaaatactagcaaataaaatcttttggtatataaaaagatcataccaagggtcatctttccaggaatttatcatttaacagaataaaaggagaaaaatcatatgaccaatatgattatattagtaggttaataacattcaatatctattcatgacttcaagaaaaactcttagcaaactaggagtagaaagtaactcccttaatctgataaaaatgaaggacttcatctaaaagaagcccacagcaaactttatacttaatggtgaattgtcgagagacttctccataagatcaagaatgagacaaggacactcaatctcaccacttctattcaacattgtactgaaaatcctagccagtgcaacaaggcaagaaaaaagaaataaagaacattaagatggaaaaggaagaaataactctgtcaatattaatgtatgacaagattccataagtagaaaatccaaaaatatctacagaaaggatattgggattaatatgtgaacttagcgaagttgctggatatgaggtcaacataaaaaaaatcatctggggccaggcacagtggctcacgcctgtaatcccagcactttgggaggccgaggcaggtggatcatgaggtcaggagtttgagaccagcctgaccaacatttctctactaaaaatacaaaaattagccaggcgtggtggcacacgcctgtagtcccagctactcaggaggctgaggcagaagaactgcttgaacccaggaggtggaggttgcagtgagccaagatcatgccatggcactccagcctgagtgacagagtgagactctgtctcaaaaaaaatcatttggatttatatatacaggttatggatccttatcccaaatgcttgggaccggaagccttttagatttcaaattttttcagattttgaaatatttgcattatacttaccagtttagtatcccaaatctgaaaatccataatctgtaatgctccaatgagcattttctttgagcctcatgttggcactcaaaaagttttggattttgaagcacttcagtttcagattttcagatttgtgatgctcaacctgtagcaagtaaaacaaatggcaaatagatttttaatgacactatttataatactatcaaaaccatcagctactttgatgtaaatttaacaaaaaatgtgcgagaactctactctgataatagcaaacattactaaataaaagtaaaagacttgcataaaaatcacaaacattaatgaataaaattaaaagaagacctgtattgaaaactaaaccatgctcatagattgaatgactctgtttcattaaaaagtcaaattttttcaaattggtctatacaaccaattttattccaatcaaaacaacagcattttttcttagacattagcaaactgattctaacatttatatggatatgtaatacaccaatacaatcttgctgaagaaaaacactggtaaatattaagatttattataaagttacagtaatgtagacgtgtggtgttggcacagaatttaaaaaataaacaaatgtaacagaacagaaaatacaaaactatcaacacagtcatctgacttgcgttgaacaagatactgcagtatgtggaggaaatgatggtatatttattaaatagtgccaggtcatatgaatatccagatagaaaaaaataaatcttaattcctaccttacacattatcacatttcatataggttccagatcgcaatgtgaaaagtaaacaataaagcttttagaagaaaacatgagaaaatgttttcatgaccttaaggtaggcaaaattttctgaaacaagttacaaaaaaacagtgtacaataagcacatgatgagtgacagaagccagataccaaagagttcatatgggatgattccatttatataaaatccaaaaaataggcaaaaccaatatatgttattagaagtcaggagactggctcttcttgaggaggggcgcaatgattggcaggtgcatgagggcttctgaggtttggaatgtcctgttttttgggaatatagcaagcatctttgtgctcatttagtcaaggaaagttgggaaggagaggcattagcttcaagacagaggaaaatccaggagtcaaaccctttgccagcaatcccctgtgccattctcctgttctcctgtgggctttctcctaccaggtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcaggtaaggcccatcaagtctgtgaggttaaagtcagttataactacagggagacaacacatacacttgacttagcagtcaaaagacctggtttaggtagcttggtccattaccagctgtgtgatcttagtcaaaacatttaacctctctgaatattgaggaaatgggatttgcttcatcaagtagctgtaaaaacactttgtaaactctaccacactggcttaaatttaaggaatctctgggattggttcttcattgatgctgtcactaaatatcaagctcctattatatgctgattatgatgctcacactggggacccagtgaaacaagaaagacagtacctgcaggaggaggaggcagaaaaaaatgaaaagctgacaataaaataattgcatgctgatggatgaataaacaaaatgtggcatatccaaataatcaaatattattcagccttaaaaaggaagaaaattctgagacatgctacaacatagaagaaacttgaggacataatgctaagtgaaataagctagtcacaaaaagacaaatactgtatgattccacttaggtgaggtacctagactagtcaaattcataggcagaaagtagactgccagttgccagagcctggggaggggaagtgaggaattcttaaaccgttgttgatggcctaatgggtataaagttccagttctgtaaaatgaaaggtctggattttacaacagtgtgaacatacttaacactactgaattgtagactcaaaaatgggtaagatagtacattttatgtgacatatttttacaacaatttttaaaattgcacattgtttttggaaaaggtcatgaggctcacctgtttctaggcactcttgcccggcatccttggagggtcatctcctcttcctccttacacaggaaggtgatttctgaccttgctgactttttccagctcagacctggcctgcgttcacactgtttcagcataagcccattcctctcattcccctctcccacatggagggtcctggattttccctatcaagctatgtttcctctccagcatgacagcactcaggaccaggcctaggaagagctgtgagtaagagaggcaagttgtctagacacctctgcttccccttgcagaacttccttctcccgtcgcctgggaaaagtgggctgtaatggagaatatcaaggcttggcagtcagactggcctggatttgaatcctgccacttacattgcttcatctcactgaggctcagtttcttccacggaccactaggttgatgtgagttaaataagtttagacagataaaatccccactacacggccttgcaccaaggtaatcaacaaatgtgagttcctttccccactccctctgtaaaaccactgtcctaaaattcctacaggtattcactcctctccctctttaccaccctgatttcagttttgtatctttctgatccttttcctcctcaaaatgaatctgtcttaggtcctatttctccagagtcctgctaggttccagaacataatctgagaaatcaataccaatgaaaataagttttcaggctctagtaagtcatgatacattcatattagcctctttgccttaacataaggagtgaataacacaaaaacgccaggcactgtcacaaccatagtggggaagatactttgggaaaaggtgtctttgggggttgcttcaagccacacagtgtatacccacccaggatggtcctggccttggttctgaatgacagacctgctggccccatttcccacctccttaacctttttatccaagaagcagaaacacattcacaaatggtcaaggggagttgtttctaaccttgtgtcaaaaaggcccagaccaattcacttgcagtagtcagagtcccggtctcaaagcccagactgatgtttctgcctacctgtgtgcttggcatgagaccaagaagcaaagggtcctagctgaggctcacccctagagttttgcagtggcccttcctggacagtttgtctttctctccatgtagtaacccagaaggtggtgcggggagcgagctgatttttggaggctacgaccactcccatttctctgggagcctgaattgggtcccagtcaccaagcaagcttactggcagattgcactggataagtgagtattccccatgaagtagtgacagtactaggggtaaactgaaaagaggcacaactcaaaccgatttaactgaaaaaccactggtcactagcagaggatgccagaagcttactgtggttggaggtatggaggtgctgagcaagtgtgcaggaagggacctctgtaaccagggcagcagacacagcttccttccttgtacacatggcgtgcttttaactcaacatacagtcaataccagtgcacagcctgctcccctttgttcttttaacattaacacacaaggcaagggatgagtaacatggggggttgcacaggtgaattgggctcagatcttgtcctcaaaaaacttgtacagaagatgagatgcacccaaaccactatcctgtaaaatggaaggtggtcagtgctccaagagaggtgccaccaatgtggtccagcagacaggcatgaccgcttctatctgaatgctccagtgcatcatggagggggttacattgaaactgagccaggaaatatatacaatatctgggcacgaagcaattggggaagtgggactacatgcctgcctcatacctagcgccgtgctagacaatgcaggaattggaaaagtgtagttcaagtttcaattcagctaggattgagttcctgcaaggtaccaggcattaggaatgcaaaaaataaaaggcctcaatgctcactgtctattcagagtttttcaaactgtaggaattcacctatttatgggtcatgacatcattttagaagatcctgacctgaccaggtgtggtggctcacacctgtaatcccaggactttgggaggccgaggcaggtggatcacaaggtcaagagattgagacacctacattttttagacgaattggaatacagtagaaaataccagagtgcacttcaattgcatgaatgtgtgtgtgtgtgcactgggtcaagaagtaaacagatttcttcctatggatctcagtagaaaacaattgaggaacactcatatggtgggtggaaatcattgatgtgctccaggcatttgagaggccaaaaaagagtgggagtttcctaggagccgggggagggaaggtgggccgaccacaaccctgtcccctcagcatccaggtgggaggcactgttatgttctgctccgagggctgccaggccattgtggacacagggacttccctcatcactggcccttccgacaagattaagcagctgcaaaacgccattggggcagcccccgtggatggagaagtgagtgcctgcctgcgcaagggagtggtggggacaggagagccaggccttctcttgggaggtggcaaggctctaaacggatcctccgtattgggttttagtatgctgtggagtgtgccaaccttaacgtcatgccggatgtcaccttcaccattaacggagtcccctataccctcagcccaactgcctacaccctactggtaagaactgtttccttattctgcaggccacagggccctccccacatgcctgccacttccccttttcaatcgcctgcactttgcccgcctttaccctaagccccgccccacgttgttctgctctcatgtggcattccctctgggagggacacagctgcctgtggtggaaagaccacggggcttgctctaatttccagttctgccatgaagcagtagtgaacttcaggcaagccatttaaggaagtcttctgatattgccatgtagggcttttccactgacaaagtttaatctcctcaaccaccaggtcagactggagctattactatctcattttataggtgagaatatcaagactcagagagtcaaataaatggttcaagatatgagctgtttgcagggaggagtggagaataagattatatttgttctaacttcaaattaacattcctcctctagcaagaaaatgtcttttgttgcagtaaattctcaagtttgtagggtgaagtagaaagggaactcccagaccttttggacacctatgagcacctcacaccacagttggtctgaattttcagcattctaggtattcggcaccacacttcaacacactaatttttccaagagtcactcacagcatcagggtgactgcatcagaagaggggtgctaaggtatagactgagggcttcagccctacccctaagcctctattaactccttcccaaagccaccaacagacaatccaaataaaaacaaatgtttgctttaaaacacagcttcatggtaagtcccctaagctcctgccacatagggattatggagctgccactctgaacaccacactgaggaccagtgagacatttagactgagccctgttcatcagtccacatgcccatcaacaccccagcacacccacactctcaccttcccccacgtgagttgagtccctgcccaggtggaaatcactgatgtgctccaggcgctggagagcccaaaaaagagtgggagtttcctagaagccaggggaggggaggtgcgtggttctttcccggtatggtgagtggttcttttagaagatcattttagaagatcatgacctgaccgggcatggtgactcacacctgtaatcccaggactttgggaggccgaggcgggtggatcacaaggtcttgtgctggttctttcgcagtacagtgagtggttctttcccaccagcagatttcaatcagagccaccttgatccatcaaaactgctgtaaaaattttgacttttcacgtccttcctctcaagaagtctccctgagccctctgcaaattttcccacaccctcatcagcaacttcacatttcaaatcattgttggaaagaccacacttgcctggtagagcacgtctttgccaaactaaaaattagattggagaaggtgacactcttctcttgaacaaggaatgcctacttgcctcatctaaagggggtcactcaaatgtttgtttccagaacatcaacaagaaaatagcagtggatagccactaacacagttctttctctcccttaacaaaaactaagctgagcttcactagaaactaaagaaaccagaatttaaaccaaggtcttccggtgccaacccttttgctcttctagccatgcagcaagggtttcccagttgtaaaatgatggtgacaggggtaggtgggagtatataacagatgaacagttctcaaaattgtagaacatagaccccaggcccataagaatggacttgtgcagacaaacactttattaagcaacctagggtagggacatatgaagcaggaggaagaacccaccgaccaaaatggtggaacccaccagctgtccaaggccacccagtgccagccaccaccaccacacaggcagcctccaggcagtactactaccttcttcccccgtttgtcatttgcatccttctttccaacccacaggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcattttacctgatcgtttcagtggtcattgatgatcattgctgagatccacactataattaggggcggcagaacaggtgtttttctaattctgctatccctttggcatttgttagttggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcctgtttaagcggagcatggtgacttatgcctgtaaccccagcactttgagagggtaagataggaggatctcctgaggccaggagtttgagaccagcctaggcaacatagcaagaacccatctctacaaaaaataaaaaattagctcagcatggtgatgcacgcctgtagtcctaacttctcaggaggtgggaagatcgcttcactccaggagttggagcctacagtgagctatgactgcaccgctgcacaccagcctgggtgacagagtgagaccctgtgtctaaaaaaaaaaaaaaaaaaatccctggttaacagggaaaagagctatgtaaatagtataatgtgaaaagagctttagtagagatatgagaacacagctattttcaagagcagtggaaaataaggttaaataagtagagtagaccccaaatgatagctctttgatagcaagcagagaagttcagattggatgtggcagcattttagtgggtcctctgggttcttaggtggggagagagacacgaggaaaacagaaggccaggatgaaggttttggggtaatctacacacaaagtaagagcaaaaaaaaaaaaaaaaagtggggggagtggaaaggaagtaggaatatattcagaaggtattcaagaaactaaataggactggataactgactggataaagcatagaaccataatggtcagaggtgacccagtgtctctaccctggtgacctagaagaattgtggcattcacgatagaagtgggggtgttgagggaagatctgttttgaatggtgatcctactttgaacgttttgggtgtagagcagtacgaggccatcaggtatccaggtggagacggcatactgctgaggtaagaggttatgactggggatagctagcagaatcttcggagtaaaagtgattgtgggagagatgaaagtatatgaattcagggaagagaaagaggagaacaaagaactaaatccaggaccccaggcttagacaataaaagttttgcattggtagtaaaagttactatgaggagaagcaaaagctacctgaagagagagagaatagttttgttttttaaggcaaagggtagaaggtaaggtgggaaagtggcgtctgatggaactagaagtgttttaagtagaagatctgtaagagcaatttcttattgatactctctcatgtataaggtattgtgagagatgcaaagatgactaaaacaagccccaaacccagatgttttcaatctcttagggtgaaacatatgaaattgctgggtttttttgtaaggcaaaatggcaatttcatatggtacagcctggtagaagaggagatagaacatatgtacaaatgcatttaatacaggcaaggtggtgagaaactcaataagagaggctcaggcaacatcctactttcatgcataatttattcctaaaagtgtatacagaagtcaaatggttgaatgtctaactacagttttatgtggggtaggtaggttctattattataaataagtgtatatgtgaaattcgaaattatccctcacctgatatatttttagcattgtataccttgtctttagttctgtttgtttttccacaattaaactcgtggcctgcctgctcaagttcagtgaatacctaaagagtccacgtagctgatgagttctgcccttatcttagtagtacagtgatgagacctctacttctcaatgcaacattagtaacagcacttttgtttttccatttccactcatttttgtgttgcaaaagataaccaagtgttaaaatgtgtgcacagcacaagcattgctgtgcagagacaaccatcctgctgaaacagaattggtacctggcagtcagcatcactaagacaagcttgaaacatttgctggcaactgaaaatttgacattggcataggaaaggcatcttaggcatgtctgatttggtaaagatataagtttggctgatgtaatagaccccaagtaataatggcatacacaagatagaggttgatttctctctgatgtcatagtctaggtgttagccatccagggctgtcaggcttcttattccatcccgagagtgttatccttttctgtatgacccaagatggctcactgccaccatgttctcattccagccagcaggaaaaggcaacaggacgaggggcaggtatggccttattttttaaaggtgcactctggaagtggcacacacagctcttcaactcatatctgactggccagaacttagtcacatggttatgctgaactgcaagggaggctgggaagtgtagttattgttctgggtgactataaagtagaatttctctaaatatagaagaaggggaaatattgggggacaatcagcagcatctgccatggtgtatgaaaggacaagtgtaggaaagaccatggccacccatccatacagagtgccacaggtgcacaaagaagagagatttcttctgattggaggactggatagggctttagggaggtcaagttcaatggatgggagataaaaaaattaaaatgccagtgctaggcattgatcctttaagcttaatacagttgagacaatggagaagttgtagaaagaaggtgaaaagatgggaaaggaagcattttagatagagcagtattagaaaaggctaacagaagtgagaacaaaggctgatggataacttatctgttttgctgaagaacaggaattataaatgtgatagtgaaataaacctggaaaagataggggccagaagattaaagaggtctatgaatgccaggcgacagggttcgggctttattctgtaagcatgggggaccattgatagtttttgagcaaggaacataattatggctgtgctttcgaagggtaactatggcaacgatgcatatgatcaattggagcagagagactggaaggaggaggacctgttaagaaaggagtccagtggtgaggttaatgtgggctgaaactgaggtcatacccttggaaatagacaagatggggccaagtgtgaggacaagaatcaatggaattcaaagaagctgggacagagaaagtgctcttggtttcctgggtctctggagtgacaatagtactgtattttcattcagttggtgaactgtagccttgattttgctgactctaggactggtcccagaatagttcattctctgcccagaacatctcagcgggcactcatcacctcccccggagctgtagcagctgttgggctagcaatgccatgaatttgtcttcctgtactgccaggagagcagctgccagcagcaactctgaacagacccatctcagggacgtggaaactattcaacttgggatgcagcaggttggccagggctgaattcagtccacatggattcatctcacccttttccaggccactttcttaccctggctgggtttcagccactcatactgcgttaggttgggtattttcttacagttctaagtgattgcatttagggatggacgctgctgaactgcgttcttcatcttttggacacctcctcccctggaagccattacgctgtcagcctttggctttgcttcctactctgctctgctcctgctcaccttttgtcctctcccacattgcgctcagtgcagacatcctcattaaagcctgtacagttctgactccatggcagcctgaccctctggttccatccctctccttctttctccttcccccagagaatgagagatgctgcagatagaactgtagcgattatttgaccctatgttattctgctttgtttaagacaggtaacatggcttcccccatccctgtgaattgtgggaagaccctgctaatgtctgaaattctgtcagcctggattgatcaagagcagtggtaaagtattatgcgagggtaggaagcctttctagggaagatgttcttgcattttctttggctccttgaagagcataaatgtattcctatttgttgctgagcctttgattgtctcttttaagtggaatctgtgttaatatggcccagcaggactctaattgataatgcattggctgtttgtttgtttttttttttaaatagacttgctgtaaattacctttcggtcatagctcacttggttttgatctcctgcttttaatagctcatttttttaggtagcttttttttttctgttgagtttttagagcaatacttctacatttctgtcctgctgtgttccttgcagagaccttctgctattttataacccactgtcagtatcttttcagcgtttctcccagcttctttctctcctcaacacatatttgttgactattttagaggttttgttctaaactcttagaggacagagatccaaagaaataaaaggagtagttctttcccatatgaaattataatctagtcagggagaaattaaattcaaatacaagaatacaaatcttcaacataaagctatatgtagtaagtactaagtatatgctgcagaagagatgaggctcagttgatgtagacaggaaacttcagtaaggaaatgagatttgaacaaagctttaaagaaaatggctcttgagagggaggggaagatactctaggaaaaaggggcacagctagaagaaagaacaaagcacttttgaggtacagtgagtagactggtttagctgggagaataagtggatgtggaagaagtggacaaaggtagatgggtttgtattgtggagggccttgactcttgattagggatttggctctatgcaatagacactggaaaccactgatggtttaaataggtatgaactctgattaaggaagattaacctagtggtagtttgctaaatgacaagaaacatgagaccaaggaaaccagttgctgcagtagatcataaggatctaaattaggttgggatggtaggaatgaaaagaaggggaatttatccttctgtccatttagcaaatatatatcttcttaccatgtgccagacacatgccagatacccacccctgtactcctagagcttacagtctagagacagatggaaagcacctggtacaggaagaatctacaggaattgctgactgatgggattcaggtttcaagtgagcttggaagccataaaagaaagaggtctgtaaagtgtctttttgacttgggtgattgataaattaatggcatctttaaaagaaatagagaggggcttttttgtttttttttttgttttttttttttttgttgttgttgttgttgtttgggtttttttttagatggagtttcgctcttgttgcccaggctggagtgcaatggcacaatctcagctcactgcatcctctgcctcccaggttcaagctattctcctgcctcagcctcccgagtagctgggattataggcatgcgccacgacgccaggctaattttgtatttttagtagagacagggcttctccatgttggtcaggttggtcttgaactcctgacctcaggtgatccgcacaccttggcctcccaaagtgctgggattacaggcataagcctctgtgcccagctgaaatctagtgttttttaacagaagttaggagaaagaattgtttttgaaggagtaaaatatgagaaatttggttttggattttaagtttaaggtgttggaagagtattgaagctgaaatttctagtagttgacaaaatgaatggctgtatgcagggctaaagagattttttggctgttggtagagatttgcacacgtgcacagaggggatggttgaaactgtggaaatatttgtgatttccaatagtaagggtttagaagaacaaaggggaaacttcctttgtatcatctgtgatactcagattacagagtgtataaaggaatttaaatgatatatttatttgtgtatcattgagtatacattttgggaacctaattatgtatcaggaattgggtttagtactggagatagagaagaataagacaatctcctattttcactaatattaaattagcagaatatcaaggaggtagacatagaaagtaaactttcttgtttggctggttatcagttgtgtcactattggaagtgatgtgagggagcagggcctaggtatcttaagaatttggtagacattcaacctgcaatactcctttcagtgggaggttagttacacaattaattaaagaaaaattattgtagagtctgtgttctcggcttcaggcccagtatttgaatgtgcgccatctctgtagttacatcactactgcggatgggttcctcccctggagttgagttcaaagtcattcaccagtctcacaggatagcattgggttgaaaagcatagagtcagctggccatggaaaatgttatagttgtggttgcaaatcggaaaagggtggaagaccagaaggttcctcattgacttatggagtgaccttgagaaggaaagtaccaggaaacatgaagctcccgggagggagaacccctgacttcctgggaccagtgcgtcactcactcattttggacatatttgggagctgtttgttccctcaggaaagattttgcccagatgtagcatctggtgttgcaagggttggcttcccttctccatggctcaagatgcctttgttcagaaattaacagaaggttctttggtgtgttttgcatgggcccagttcatgtagaaccttaggtcattgttgagtcctttttggaggaagagttgggaggacttctcacacatgggtaaagcagaatggaagagacgcaagaaggccatttgggaatcagcaagacagggtgatccagtctttggaagagagaaagaattcagttaaaagttctttgggaagctttgtgactttgtgtgggaaaaaccagagctttgagccagaaaaacttgggtctgaatcttgtctcttctactcctagcttgtgaccttaagcaagtcacttaacccctgttagcctcaatttcttacctgtgaaatgttgacagtaatacttaccttgaaggattcttctaaggatatatataatgtatatacagcactagctaatgtttgtgacttaatggatgctcaataaatggtagctgatataattatcaggaaaagtcaatcctgatagttaagatcagccacagaagagtcagccctgatagttaagatcacaagttctgggaaccagatttcctgggttcacaatcctggatttctcccacttacttgctgtgtgattttagatgaaaggttttaatcacctcagtatcctcgtttgcaaaatgaagataatattcataactaccttatggagttgttatgctggttaagtgaattaataatatgtgaaacacttaggacagcttggcacatagtaaatgtaaatagtagcaactattatccctatcctcaggatttgggcctgagcacagctgtactgggtaaaacactggtatattagatacactagtcattccttgtgcagagttaagtattcctaagcctggctgggtaatatgtcagtttccattttcttcagacccctgtgggccctcatgaatgacaaattcatcccctaccctgatttttatggtatagctacattgggcaggacataggcaattatgtgactctgtgtaattgcatggtcagtccctataaaaactcagcaattgtatgttttgttctgtaaggtgtcatatagttcaaccttggtgggttacttttagatccaggctcataatcatgaagaggaagacatttgtcatacaaccactctctgattttctcgtcctcttggagttaatagttagccctattgccaaattgctgagtttctataaagatatactgttgaggcccacaggtcccaattttgacttgggcaaataaaagaaggccagtcctattcagcctcctgcagtatctaccatcgaggccagcaggccagtgcagtacaaaccttagtcatgaacataacagtatgtggtttactgggttgtttgtctcatgaggccaaacagaagctcccaagcttctgcataaatggctttatatcttccttttagggtagggaatgataagagggcaggttagaagcaaaatatgcttttatgagcaattgggaggatgttggagactcctgagagtttcctgtgtctcctaggatttgccactggaatgtcagcaggccatacctcaggcgttcagctccatggagcaaagacagtagtgatcacgttccttgacaacagtgctagtgtgcggggagcttttagttttccttttctctgctcctgtaagccccataataattctgtagcagacacaggaagcaatgtgtctaactactactaggcaatgtgttcttgggatttttaattctcaggaattcgcagccaattaaatgaatttactttgatccagttctcttttcaaggcaaaagctgtgtcatcttattgggagctgactgtgttaagtgggagggtttacaagataagaagaaaagacagtctctgccatacgtgtttttataattgaaatgggggaaatcgggcaggctgagagagaataataagaacacatgtgcacaggaatttaaaaatagcaccccatttaaagcaggttccagtagtcaccaggaaaagaagaaaggtggagtactcaggagggacttgtacttggttcagtcagggaaaggtaaaagatagtatagttatgttctcaattagacttgttccctggttaattgaagtaaagactttaatatctaattcctacactgcacagaagtatcacacattgaaacagtgtgacatgggaaggactcactgttaacgaaagatttagagagaatgaaaaaaaaagtaggatttgggtttttcagagttgaaataggttcatcttttctgctagctcctccttttatacatctccactgtcgttgctccttgggttttaaattcagggagaatcaatgagcacagttctgcgtcttaatatatttagggtgcagctgtttaaagagccaggattagaaaatgaatcgaacaaactaggattatcttcaacagtaggatgctgagctgtgtttgctgattcctgcttaagcagtcgggacagggcatccttgcatgaaattcagacatccctccctggcagcctctgtggtaaagtagaggttgcagaacaagtctggcagctctcagcccgaacccttgtaaacaacagatgttcataactaagttctagggtgggggtaggggttattgttgatgcttgaaattctttgaatttataggcagcatctcagggatttagcaaaaggaggaagttatacagaattgatttctgcagtgtacaggtagaaatgatgcctcatggatttccttgaagacaaagcacaggctattgtgtggactctaaaacagagcaaggtgaacccaggaaggcaggcacagttaagaaagggttggcttcttaggtgtattgacttcctcccctccttctcctctctcactcctttttatacattgactggatttgtcagtcttgttcttgctcctgttttctccggtaatgcgtggaaatgtgtgtcctttcttaccacagagtcctagatacatgtgcatacaaatacacagtgtattaggccattttttgcgatgctgtaaataaatacctgaggctgggtaatttctaaagaaaaaaggtttgattggctcatggttctgcaggctgtacaggaggcatggtgctggtgtcggcttctggtgaggcctcaggaagcttacaatcatggcagaagtcaccggggagccagcatgtcacatggtgagagtgggagtgagagtcgggggaggtcccagacttttgaacaaccagatctcttgtgaactaagtgagcatgaactcacttatcaccacagagatggtgctaaaccattcatgaaggatctacccccatgacccagtcacctcccaccaggccccacctccaacatttggaatcacatttcaacatgagatttggggggggacagacatccaaaccatatcacataggaggaaaaacacacaggaagagcacacaggtgcacttcccttagtgccctctgaaggacgcaactcaggtttttatgatatactgattaatgggttattgttatgggctttgtcttggattttaacctgatactttctcagtgttggttttgctagatgttcattacttcattaaacagaggtgccgggtgcggtggctcacgcctgtaatcccagcactttgggaggccgaggcgggtggatcacgaggtcaggagatcgagaccatcctggctaatacggcgaaaccccatctctactaaaaatacaaaaaattatccgggtgtggtggcgggtgcctgtagtcccacctactcagaaggctgaggcaggagaatggtgtgaacccaggaggcggagctttcagtgagccgagatcgcgccactgcactccagcctgggtgacagagcgagactccgtctcaaaaaaaaacaacaacaaaaaacagaggtgagtgatgagaatatggcttatgaagacttcagtgctacctcttcttgatccccatcccctagtccccaagcacacataccgagtttccagccagatgataagtgcttaggaaaccttctactttacagcatagttcagggaagccataatagaaaaaatataatacatctttggtaggcttccttggcaccaaattgacgaagactttagaaaggttcttatcgtacatcagatgaaaaaaagcgatttaccagatctgggaatgtttttgagccactctagcaaaaaacaactggcttgaaaatctttgataaaatcgcttattcttttggaagctaagaacatctttgtacaattttttgttgttgttgttttttgttttttgagatggagtctctcactctgttgcccaggctggggtgcaatgatgccatttcggctcactgcaacctctgcctcccaggttcaagcgattctcgtgcctcagcctcccaagtacctgggattacaggtgcgcaccaccatgcctggctactttttatatttttagtagagatggggtttttccacgttggccaggctggtctcgaactcctgacctcaggtgatctgcccacctcgacctcccaaactgctgggattacaggcgtgagccactgcgcccggcccatctttgtactattattccttctggaaaagaagtccacttctggctgttttgtccatttgtacgaatttggtgaacaccaatcctggtatgtgaggttcacttaatctttcagcaaacatttattgaacatttattctgtgccaagagttgtacaaggaattaaatatacatagaagaataagctaccattctagcccatgggagttattacttaatgtgaaatattttaagtttgtttatatacatttgtatgtgctctgataaggcgtagacttccaggttgaggagacagaattgttgggttatgagtcaccctgttagtcacctttattatatgtgaatcagtaataaacacttgacttcattctcatcgctaatgaccaataggttctctgcaggtttggggtcacaaagaggtgtaggatcctgttctttccctcaggaagctcatggtgtcatgtggaagacagagagtttatgggaaaaagataacacaaaataatatacacttactgccaaaggagagatgggagaaatgatttcatttttcttcagaatgcaatctgtaaacagttttaaaattttgccataatgttagacttacagaaaaattgcaggaatagcacaaagaatttttgtatactaccattttatccagattgccccaaaatgttaacatattactacatttgctttatacttcacccttttcatacccaattctcacacacatattttgtttttctgaaacacttgagagtaaattgcagacatgatgaccttttatccatacatactttagggtgtatttactaaaaataaggatgttcttttgcataatcgtagtgcagtcatcgaaatcaggacatacagattgatacaatactattatctaatcaatagacattcagattttaccagttgttctaaaaatggccttttttggcaaacgaaagtccaagattatgcaattcattcaattgtcttatctctttactttcctttaatgtgggatgatttccaagtctttatatttcaagacattgacgttggccccgttattttgtagaatgtcccttaatttgatatttctggcaatttctgataatttccttattattagattcaagtcacacacttttggcaggaataccataaaatgtaatgtcacgttcttctcagtgcatcatatcaggaagcacttgctgatgatttgtgccataactgatgatgttaaatttgatcatttggttacagttgtgtctgctaggtttctccaccatgaagttgttctataagctttgtaattaatgtatatattgtggagagatactttgagaccatgtaaatatcagcttacccttcaactcttatactcactagttttagcatccattataatttcttgcttgaatcactttctattatgatggttaccaaatagtcatttttccagttttcatcattccttctacatttatcagttgcaattctactgtaaggaagagcttttccatcacccccactttttggtctggttgttggtttatatcagtgtggacttgtggattattattttattcaacaggttataatcctttaccatctttattttaatgttcatattgttctatatttggccaatggagtcccttcaagctggcttctgtgtcttattgatatgtccccatcgttctttgagcacttccttactttatggcacaacaagatgttccaggcttaacttgtactttccttgcctttactgtggagttgaccattttttcagagagcctcggttgcttttagtgggaaatggtatttagaaaccatggatgctaaatatgctctttgtaactgaagtaccattatttatagtccctttcagcagacagaggtagtagatatatgtatgtacacatagacacatacacacacacacccatgtacttctataaatagctatttctttatctgtctgtatatttatatatattaaagcctatgagatcatatcagtatctttcattccaatccaataccacatgttttatttaattttctcccctttcctgttctctgaacagtgagaaacctggttcctattatccataacacacattttcacttaattgctcagtcctagagtgtacagaaagttgtttcagaattactaacccaggccgggcgcgatggctcacacctgtaatcccagtactttgggaggccgaggcgggccgatcatgaggtcaggagatcaagaccatcctggctaacacggtgaaaccctgtctctactaaaaaatacaaaaaaaaaaaattagccgggcgtggtggcaggcgcctgtggtcccagctactggggaggctgaggcaggagaatggggtgaacccgggaggtggagcttgcagtgagccgagatcgtgccactgcactccagcctgggtgacagaccgagactccatatcaaaaaaaaaaaaaaaaaaaagaattactaacccatgcctctgaaaaagaagactactgactagattttaatactggtttagagttctttttgttattagccttgagggccaagacacaatgttcaaaagttagctgactagttctttctttcctatcttagtctgttttgtgtcgccataacagaatacctgagtccaggtaatttataaagaaaagaagcttatttggctcacgactgtggtggcttgagagtataagaatgtggcatcagcatctgctcagctcttggtgggggccatgtgctgcctgacaacatggcggagaagctgaaaggctagggaatgagtgaaaagaaagcaaacactaggaagaagcttgctttacaacaactcactctctcaggaactaatccagtcccacaagagtgagaattcatttccatgagaatattaatcttattcatgaaggattcttcccatgacccagacaacccccagtggcccagcctctcaataccacttgcaattgcaatcaaatttcaacatgagttttggagggaacaaaccagattcaaaccatagcatccctcaacctccagaccttcaatgtagttatattatttgtttgaaatataatttggtttatttatttgtttgtatttaatgttttcctctccggaatggggtcttgacatttctcactgccaaaccttttctcttgactaaaaaagatggagcagattcaggagaagtgagagacccatgtatccatagattaagtcagggctttagcagaagtcagtgatggggacataggccagacatgcactgagaacaaaccaaccattttcccctacttctgggccagccctgtctctaagcaagccatcttatggattgagacccttgccagtttctcctaagcctgctcctaggttctccttgccattctccctgatcacctcttttgcatttagcgaaccaagaatccagcatcagcatcagcatcagcatcagcatcagcatcagcatctgctcagctgtaggccatgattgtctgtactgtttaccagcagctcatgtaatatgcttgatgtaagaccttaggataatgttgatctggcctttcagacatgaagccccggggcactgcacattgacacccaaacttgcaaacttttacgtccttttgcgagactgtttgctagtgccctgttctgaaatccttgaaatttctcctcctggactttcttcagttacatgctttggcctctctaatagctcttttgcatcaattctgatgacctggccattttctcctgtctgtctgggaatggcttccagaatccccttcctctgccccatttaaccctcttcctccatctcccacacactcattttatttctctttcctccagacacatataacctggtcagtgctgctgattccagctgttctgaatcttgtgtacagcttaagttcaaaaacagatgggcccaaagtatcctagatgctgtgccaatttccactgcatgaaaacaaattactgaaaagcatcaggaaattttagaatagttttggggtttgattctctatcttctcaatggtccttcctccccaactcttccatttctcttcaccgtccctgtccccccattataccttgccactttccatctcttcttcatattcctcacttagcaaaggctggtttttaaaacctttattctcatttttactctttctatgtactgataggtttaaccatcaggatgggactgtgttgataatcaagctagggctgttggttgtttttctagacgtttatacccttttaaaatcttccatctaggactagggaccttatgtccttatgtccttttcatatagagaaggtaaggctggggcctctgtgtctgtgggtacatttgtaggtcaaataattcaccagcttgcaaataaagtagatattcttctattgactttatcactggggggtgcacaattgtgccagtgccattgtctgcccttgtcgggagtgagtagacactccctgtagacagggagcgtgttccttggaaagcagtgacattggacccacaccattgctttcagaatcctcattctgggaatatgccaactgctttctcccagtgttctgtaggacattgtttagctttggcattcctagtcaccctaaaaataagaggaaaacaatcatcgtagttggaccacttatcttacaggtatgtaaggaagacactggggtcatttacagagcatggggagaaagctgttggcatggtacagtggttattgggtgcccactgtgaacagacattgtaggaactgtcttcaagagaagcccttgagggataggcttctagaagttcaggtacatgctggatttatctatgcaaattataatgtttccccgcttccctccctccctccctccctccttctcttctttagaagagaatcctcagattctcaaaaagtatcaagcagagtcctatggatggtaactgaaagaaaaaaagaaaaaaacgattctcaaagggatctggaatacgtaattatctcccataatttaagaccattactctggagcagtgactttaaaacattttgatcatgaatctctatattttatactacaagctggaatatacttatatacacataaatagctgagaacaatactttcacagaacaatacttatctttgctttgtgtgatgtactctgagattttctactttgttctgttattctttttttttgttgagatggggtctcactctttcacccgggctggagtgtaatggcgccatcttggctcactgcaacctctgcctcctgagctcaagtgatcctcccacctcagcctcccgagtagctaggaccacaggtgcacaccaccatgcccagctagttttttgtatttttggtagagacaaggttttactgtgttgcccaagctggtctcaaactcctgacctcaagtgatctgcctgcctcagcctcccaaagtgctgggaatgcaggtgtgaggcactgcatccaggctacttttttctgttattctcttctactgttgcctacttaattttttgagaaatgctagttggtgacctataagttgatttttttaaacctcactaatgggttgaatcccacagtttgtaaaacattgctttaagagcattgttttttaaattttttggtgtgcataaaattacctgacatgctgatttgaaaggcagattcctgggcatcagtccacccctagtaagttgtaatctctggcagacgagcataagaatccacattttaaacaagcattccaggtgattctgatgcaaggtggtttggggtcttgaagcctcacacttacagaaactgctctcttttgcatttatgaacctggctgttgaaggcttcagatcacatgcttggggatggtagatactagtggggatcatctgactccagactgggaatcttctcgttacaggatgaccccaatcacttaggtttacttctggatcttgataattccttgatagtcctcttttactgatgtctcttatggcccttaagaaggcagagaaggggttaactgaggccacagaatagagagagtgaaggaactgaagggtcattttacagagtgactggggtgtggcccagtcctccagtaggtgcccagagccagtccaaaattagaatggggtgggattcaaaactgcttttcctattcacttgcctttcatgtgtaaccacatgcagtgtgtcaacatgctttcaggcgccgttaggcagcagcagttttgctccctctgggttcatggacccttggtattcttgttatgtgttgtcttagaatagctctgcgctctggggctctgagcattgtccattaactctttcagcaccagccctttgagatgctaagggcttttgaatgaaatgtaataaccaccacaatgaaataagaaaacggttactagtcaggagacctggattcttgccctgctccaccactgtctgtgtgacctcaggctccctgagcctcagtttcctcactcagaaaatgacaggcttggtctagactctagaccatcttgaaagtcccttctagctctgaaattccatgattctatttttgtacactctggccttttctctttgcacatgattctttcgtttaaagtctcagctgcattaggcacagaagattcactgagtttgggaatttccagagaatcagatgataaattaatagcaacaaaatgtattcctggccaggtgaggtggctcatacttgtgagcctggcactttgggaggctgaggcgggaggattgcttgagcccaggagtttgaggctacagtgaaccatggtcatgcccctgtactccaacctgggcaacagagcaagaccccatctctgcaaaaaaaaagtatgggccgggtgcggtggttcacacctgtaatcccagcactttgggaggccaatgtggacagatcacctgaggtcaggagttcgagaccagcctgaccaacatggaaaaaccctgtctctactaaaaaacacaaaattagccgggcatggtggcacatgcctgtaatcccagctactcaggaggctgaggcaggagaatcgcttgaacccaggaggcggaggttgcggtgagccgagatcacaccattgcactctagcctggacaacaagagcgaaactccgtctcaaaaaaaaaaaaaaggaagtgttcctatttagtatactaatgaagtagggaatttatgaaacaagtttattataaaaggaattttgagatgtatttgtcttttcagacatgattctagtcactttgttttgtgggtatgaattcattgtgtgggctgttgagtaatgatagttgtcataattataagaaaagatgttgatactgatatatagttgtagaacactttcatgtttataaagtttgtttaagggcatcaccttgtttgattggatcttcacaaaagtcatgtgtgttaggcagggcaggtctgctgtccctgcttatcccatttatttatttattttttatttatttatttttttaaaagataaacagttattcatttttgtttaagacatcaggagtactaataaagaaccaactggtaaactgctgataattccatataatatatctagcactacaactacactgaatcattcttttttttttttttttaatactttaagttttagggtacatgtgcacattgtgcaggttagttacatatgtatacatgtgccatgctggtgcgctgcacccactaactcgtcatctagcgttaggtatatctcccaatgctatccctcccccctccccccaccccaccacagtccccagagtgtgatattccccttcctgtgtccatgtgatctcattgttcaaatcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgcgatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgcagattctggatattagccctttgtcagatgagtaggttgcgaaaattttctcccattttgtaggttgcctgttcactctgatggtagtttcttttgctgtgcagaagctctttagttttatgagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctctttgttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacgaaggggttttctagataaacaatcatgtcatctgcaaacagggacaatttgacttcctcttttcctaattgaataccctttatttccttctcctgcctgattgtcctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatagtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactactgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcattcagtgctataaatttccctctacacactgctttgaatgcgtcccagagattctggtatgttgtgtctttgttctcgttggtttcaaagaacatctttatttctgccttcattttgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcatgttgaattgatccctttaccattatgtaacggccttctttgtctcttttgatctttgttggtttaaagtctgttttatcagagactaggattgcaacccccgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacatttttcccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcctcactttcaggtacaccaatcagacatagatttggtcttttcacatagtcccatatttcttggaggctttgctcatttctttttattcttttttctctaaacttcccttctcgcttcctttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtgctcctgtagctcagagtaatttgatcgtctgaagccttcttctctcagctcgtcaaaatcattctccatccagctttgttccgttgctggtgaggaactgcgttcctttggacgaggagaggcgctctgcattttagagtttccagtttttctgttctgttttttccccatctttgtggttttctctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctcagatggaaatgcagaaatcacccgtcttctgcgtcgctcacgctgggagctgtagaccggagctgttcctattcggccatcttggctcctcccccctacactgaatcatttattttgagccagggcttgaagcagacaatccaagcatccttctaaactatcctcagtcttgtcaacagctgttatcttcagcttcttcaaggtatcactgagattatccatgttgctccccgagggcgaggaaccggcggggcgaggcgaaggtctctggtgcgggcggcgcggctctgtgtcctccctctacctccgtctctatttatttattttttaagagacaggtcctatgttgcccaggctggtcatttacaggcacaatcattgtgcactgtggcctcaagctcctgggctcaagcgatcttcccacctcagcttcccgagtagccaggagtacaggcacgtgtcaccatacctggcttccatttactttttaaaacaggtgaagagattttgagacccagaatgcatttgtgacttgcccaaagttacctggctagtaagtggcagagctaagcctagactctgggtcttaagcatagttcaaggcgctttccacagagtgtagatggagtttcacatttttcatccagattccttaaggacctgaacttgctaatttgatctactaacctggaaattgactagggcttctcttataccactcagccctttaaagttttgccagtaaagtatcaacatggttaataatatgctgtaatttagagcacacaagccaatggacatacaaatttggtcattcagtagccacccagagagtgagcacagatacacactggagcagctgatttggcaagattggtggaggctgaacatattaactagtcattaaatgaatcatggtctttctgtcctcaacatttacaggattgctttggctctggcatctgttgttagtcaatactgattaaggacccacctattcttggtgataggtgttcattaaacattctaaatataccctgtcctcaagagaataccttactgggcctgggggttgttcctcctgcacccccacacaaaaagagacttccttctaataaaggcaagataaatatccaaataacacatgagaactgataatgacacatgcagccaatctgatgactgtgtagacttcattccatttagatctatagtttcacagaatcaagaattttatttttttcccctccttttcattgttgttatgagccatgtaaggggactcattgtcccagggacgggtatttgggagggggagatctttatggataccctttcttctcagtggcttattgctatttggcatactaaagtacaatttgctagccaggaggagtttctggctgtagatcaaacttctccgctcatgcctggtgccagagagatgcttgctcttaagggggtggttactgctttgataataagtgtgtggatttctgagtgacgtcattccactttggcacagacaggtatttatttctctagaatgaactaccaggggtgagccagactgtctgcctcagtcatttcccaaggtttcatttattttaaaaatctgctaacacatctgtgtgtatttttttttctctgtatgtttgtcaagtgctataattacttatagggcttctggtgacatcttaattaactagagaagaaaaaatcaaagatataattgtagagttgttcacaggtttttctatggactttgtggatccaactgtcaacatgatattgatggttacgaattctttttaagctgagaaacgtataaattttatgttcctcggtcattgatcacacctttgttctgtcttttacccttgctatggtgttttagtttaactgagtgaatgagtcagctcaggcctttgatgtgatcacagcctattttggggggctttcagggagcatatttaatacctaagtgcatttctaggcccttagttctatggattatattggggtggcattgtagcatgtagattgtaccaagagggtttaaaagcctctttattcattcctccctatagttctgggaatgctagtgctaacacatgggatgtaaacaaagggaaggtcccaggtctacagaagctatagagggagctggtgggcaggcagattttctaagtcagccaaatcagggttttgcagtgggttcatccaagccaatgtacacacaagccacaagaccaggataagatgtgggttgtggctgatgcacagtttaggagcaggaaagccatgtcttggatccaggaagtctgcaaacatgggagaagcaggtcagaaaaaagaatgttgatcctgttattcctagaatagtggctagcccataataggaggctcaattaatatttgttaaatgaatgaatgaaataagaagacatcagggactcagagaaggagcctggacaataagatatcagaaactaggcaagaaatgtggatggcagagattcaaatcttgtgtagacccccgtgtctggtcttatgggatccatagatctatcttaagagatatgaagaccctccatttgcctcctttctgctgtgagcaccgtgccataggggtggttgaaaggaaggcagaatctctcacttaacataaattgatggagacatttccagttagtgtctacgatagcttaaatttggggaccattcctagttctctgacctaacccacaagaaccttggtcctataatcattcaggaaatcgtaagcacttaatagatgtcagacatggtgctagtccagttctctacttcaaagcagattcctaaggtccggctcttgggcatgctgttctctcaagggtgtggttctgctccatggaactaatccagagccacaagaatcttattttcatacagtccttcccccaaacctgattataggggacaatttaggctattttgagaaggtgggtctaccactgcttgaatcctttctaatcatctgtctaggctaccgaagacaatttgtggtactcacttgtccctgaaaatttgaaagttcatttctccatatgtagactatattatttttgcctttggcacttttctctgtctctgaactctcctcctctgatctcattgctggcaacgctgaagccaaagctgtgataagcccagagaagtgtgcccgccccctgcctgcccgtctgtctttgaaagataccttcaggctgccgctgtactactgggtcacaaaaccagcatccaccattacaggcagaatcgttttcaagtcatttcctaccttggtgatttttaccccctccttcttttaacaccttccccagcaaatccaatccatcctctggcttatctgggtcagcaagggtctgattttatgcatgacactgtcagaccataaatccgctgcagctttgcctctctatccagcctgcctgcttctgtcagcatcagcaaaatgcataatagagaaaataagccagaaaggctaataacactcatctgaataaaataatctctttggctgcctcagttcatttcattttaatcaaggtgccaggagggaatttaggttaaaaaatccagcctccttcttgtcacaagttccctgtccaaccatcacttaaatgattccttttatcatgcatgtacctttttttattcaccacatacttgtatgttcaataacatatattgaatgatgtatttaactctttaagttttgtctatcatcacagataggtctgtttttaaaagcgagaaattatattctgcttagatgtattgatagttgccatctctctatgcagattggcaggtttgataggaattctgagacaggggatgggagcttagtataagttgctgaagcatctagggttttggcaatctgtgctccctttggattcctttctgtcaacctcagcacacagttcccagtgtggaatgcaggactgattgttctaccttgtcccttagggaaaggacagtgggagattaaaatctgctctcctgttggtatctctctcacgtcttcccagagccttacggctgctttgttaattgcctgttgctgctgtcttactcaaaccattatttgctgaaggctgtgcattttcagcaggcagcaatcttggccctggcccagagccgggtgagaagcatgttggaaattgatgaaagctgagtcctagtttgtttggaaataaaaataataatatttcttcacatttgtatagtgctgaactattggcatagttcttttgcatccatcatttcatttgatccacacaacagccctgagaggtgagcaacttagagactattggcccaaaaggaaacacacctcgttatagcaatgcagaagctcaagctatattccagcaatgccagcctcatgccatgcattccatctgcacagccatgaacgtagcaattattaattaaatggcaccttaggtcaggagagcgtctaggattttacagccatactttgaagatctttgaggagtgagatgtataccaatagggcacgtgtccattttatagatgagatgataaaaaccaaacagaggtgatatggaaaagaaccataatagagaggccaacttggacctttatggacttggctcttcaccatggatattttagagaaatccctttaagcgcttgttgctaagtttgttgaacgtccataaatagtccaaggtgagggagaaaagctggtctaatgtcttcgaagctaatgattcagctatgcaggtttatctctttcagtgcatttacagtgataatgtcttctgcagatgtacaggcagcatgtgactttccgggtctcctttcgactccagagtcattccctctcaagtacagtatgatgttttcttgatcttcctcctgaaaaacattttaagtaagaaaaatactcctaggtattttgtctgctttttagggattagtgtttgaggaggtttgcagctgctcagcacattcctaagggatgcagaccctttcctttaaaggcccaagtattatacaacctaaggctctgggggtggggaaagtaaagagactgtgcaaacaaatgatagatggaaaagatataaagacaaatttcaatctcctaaccaaacgaagttcccttggcttcagcggtcccaaataaaatgaggctgcaaagcttctggagcaggaaaccactctagcagagccttaatatgctccctatgaaatcacgtctcgttgccgtgcttattttccagcctgaagtgtgtttcatctttgttcgtgttggctgggaaaattgtctgtatatttgtgatcccctcctcccactttctctctaccttacttgctctaccactacccaaaaataaataaatgaattaattgaaacacctcagttgaaaggaagaatatgtctgagaaagcttacagactcaaaggaccagaaatattgtgtgaaaagctgcattaatagtaggagaggctgagaactcctggaagaaacagccaacaggatctagtgctggttttttaagcatagactccttttttaaaataaaaatcttgcatagagcctcaatatatgaaacagatcaaagcagtatttttattggtataaatctgcttttaaagtacaaatttatagagtacttattatactgtcagtcaatgagaacaatgaggctgttttcatgaactaaaaatattgagatcaggattatgaatcagttatagttttatattcatttcagcatctggttttggtttaggtagtcagtccaatatcaagaaaattctgattagcatagataagttattgtaatcttgagctttaaattgatttagatggaaaaaagaagatatttttgttttaaagttgagtcactatcatcacctagcagctattccccttcataaatattaattggataagccccaacatgtataataggcatcgcaacaactgatgatgagatggtatgatattaagcatgttgattttcgctacccaaccacggtctaacatgaacccagcctaggcccttgagccttctatggcatgtgattgaaccttgctgctgtgtgtcaagttataggctcacctgtacagctttattggaggaggcacacacaggcttgaatgaaaaaataaacctatgcaaagctacatgtattctaattaatagcatattgttcagaagttccaaggcatacagtgattctttcttccagggtttacataaaacaatgctagcagcctgcgagacattgcagtggtatctaatgcagggagactgggtcctgggtctcttgctcatgtcagtgagggttgctcatttgaatggatgtgtcaccgttttttaaattgaaatgtgattttctgctaattccagagtatctcagaacacagtttaaaagctcctgctctctgaaaccaatactaatactgtaactatcgcacaaaatgctgtaaggatggaaataaatacatgtgaaaagtacttatagcaccttgcaagttcttttttcttttttttcttttgttttgagatggagtcttgctctcacccaggctggagtgcagtggcatgatctcagctcactgcaacctctgcctccagggttcaagtgattctcctgcctcagccgcccaagtagctgggattacaggtgtgcaccatccacactgaggtaattttgtatttttagtagagatggggttttgccatgctggccaggctggtcttgaactcttggtctcaagtgatccacctgccttggcctcccaaagtgctgggattgcaggtgtgagccacaccttacaagttctcaataaaacttattagcattaagtgataaggcattttattttaaaagatttctacttccagccatcctgtttattgacccatctttgttcagtcatcttttcttttgaggacaccctgggaatatgtgctctgcatccttttccatggtgttaggttgattttgcctcctctgcttcctcttttgatctgcggtctacctttctgagctagctggccttttgtttgtaccaccattaaagttctactttactataggtctttctttgtctcccttactatattgcagcatttgcacttttataaccactaaagcacctaacaccatgccttgttcatttaagatacaaatgtgtgtacatttgtggaattgaattgtggcattatttgtgtgtatgtaaagtgctatagggaaagaaccagtatagaccccccccaatccatcttctcccttaagaaatagattgaaaccagttgtcaatgtaaagtctcatgagatctgcccctttaaaaagcatgcttactgaggacatgggtatcttgccgagagacaccacttgattaaaatgtaaattaggttatttagaattttgtaactgaaatctaattggaatcattttgaaagttttcttgcaatggaaacatcagatgctatggaatgcatgtgttcaaatatcttaccattttgaatttaggattgtttccagttcacttttttttccccagatactaaacattttgaaaggagtaaattaattatgtgtctctcttcctctcagctggtatatttttgatttccatagaaatctttcagtttccctaaaaaggtaagtgttgtcacagtgattggcacgcttaagagttagtgattttggctacagaagagtgatgcctggggcagggggtgagtggtacctggatataggtttagaacagtttcaatttggactctaatattaattggtttgaagtaacttcttggttgggttagacagatatttgatttgtctgatgtattctgaagtccaagtaagtatggcatgattatttgttaatagttactactatagaattggaaaagccttctaagttgaacttcatggtttacaaatcacaagtgcctggcctttagtgctgaatggaggcagtactgactcaataaccaagctactctcaactcactttctttgtagtaggagtctgactggagcagggaagagaggaaagggggaaagaaacagatagttattatttgcagtgaatgacagtactcgctttgcagttataggcttggtttgaattctggaattgccgctttttagctatatgaccttgggcaaagtgtttaaaaatttttagtctacttttcctcatctgccaaatgtggttaataacacccacctcatcaggtagttgtggggtttaagtcaaacaacatgtataaagggcccagatatgtgtacagtatcccttgataaatagtactgcaaattattcctacttttgtttctctccttaaagaaatccaacttccaaatgtagaactttctgttgcttaagttaatgctgagttggtaatcaataattcttttggatcacaatgttttcattagaaatgagcatctagggctgggcgcggtggctcactcctataatcccagcattttgggaggccaaggtgggtggatcacttgaggtcgggagttcaagatcagcatggtcaacatggtgaaaacccatctctactaaaaatacaaaagttagctgggcgtggtggcaggtgcctataatcccagctactagggaggctgaggcaggagaatctcttgaacgcgggaggcggaggttgcagtgagccaagattgtgccactgtactccagcctgggtgacagagtgagactttgtctcaaaaaaaaaagggaatgagcgccttggtttagcactttactgctccactcaagctgtagacattttaggaacgcatgttcaggtatggtttgtgttcttgattgtatgggacatgagatcatggctcaataaatgaaatcaaaacttccttagatgtgttctgtggaactccagagttttcagtaacattttaatggcatatgtctccaaatttgcctttattaaatcctacaatggatacatttgtggggattttgtagtgctgtagtgatttttgtctctagacaaaatctctaactttggtttctaaccctagagacaaaccaaatgacttagtggctaaaatgatggacttcagaatcaccttagacctggtctagccagacaatgcagaactgttgttctagtccctggcgccctcttacttgttgtgttagtcttactcgctgtagacaagtgacaacctctctgagcttcagttttctaatcagttgaagggggataatggtagttctttccttaaaatgaaatgatagagcttagatgagatgagataatacgtataaagcattcaccaagttcttagaacatagtaggtgcctaacagataatcctgtttctccttgcacatcccctcttccctccctctccttcttgtccttattttctccttttttctccactgagtttttagaaaaggagaaaactagagaggtgagcttcaggaaaaatatctttatttctggattggctttgattgctgtgattttaggacacggactatagttgtagatgttgccctggctgcgtatcaacaatgacttcttttccttgatgtttcttcacaggaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaaggtacagagatatttctagtcacagaggttcttgggtggagcaatgacacaatttttaaaatcctattagatattatgttgattacctgggtgacaaaattatctgtacaccagacccccatgacatgcaatttacccatgtaacaaacttgcacatataccccccttgaacctaaaataaaagttggaaagaaaaaataaaagaaagaatatcttattggcccacttcataggctttccactagtcattccctaccacatacttgcggagaaaaaaaatatttgaattggcattcctttcttcctttctgagctgaattaatagtagccttgggaaaggaaccatttgcaaggtataaacccagggctggtactataattcataatctgcatctattaacaaaaactgtgttttgggaagttttcttaaagtgatttgtgaagctgttgagcttaaggggccaacactgtcattttatgttttcctattctagttcatttagcaaactcatatacgtttatgtttttagtttagttttcttcccagggtcttatcttggccaaggtagactcaaaagtgtggttattcttatcgtggtatgtctttgtctttgggtctctgaatgctttcggaactcaattgttatcgtacttccttgggtataggttgaacaatttgacaaaggaaaactcaaaataatcatgataatcttaaggagccaattcaccttacctgtcaacgatggaactagcctcttgaaaatccaggaagctcttttctaagctgtctcagcttgagctcaaagtggaatcatttattcatgaggttgggttacagacagcggtgaaggccccaaccattgtatatgatatgccatgtctaccattcaagcattgacatccccggaagactttccagaaggcaaataatcttcctaaaagttataggtagaaaaagattatagagggctatttagaattcatcagtttccaggtgacaaaatccattattaaaatttgaaagtatgagagaaaagactggtaaacaggattgtagtcgatacagtcaaagctcttgatcagctttccagttctcaggaatttttccagatttcactagatctggaattaataccccattttttttctgtaattaccagcctgatcaaataactgatttggaatcttccatctacctaattgcatccgtgaaggtgctttccctgtgtcttagagacagaatattgagggtacaatcatctgacgacgaaaagaaggcagagaaagataactcctcccagagctcactggcttttattagtagcccggctgtgctgtggttggggccacacctcattttggagtgagggtacttctcaccatctcctccatggtttccagcatcagcttcagcttggttgtcattaatttgaattattctgcaatacttggtgatgcatgtgtgtgactaaaattaaaacctatttaggtgaaattttgacagctcgtctctatgaccttgacagccacttagactatctcaagaaggaaagggcttgactgatagtttcctcctccgttttctttgttcatctgagaaaacaacttttataagatctgttcacctagctagacttcacccagtctctcagctccctttttaccaagccttagaaggttagagaaaaaccaggctagataatttaatagcctctccagatctcagagatgcttatactgaaggcagccagatagcaaagtcacgagtgttcctggctcttcaagtgccctatgcacatttcaccaaaggtaggtacatggcatgtatacaaggtgtggggcatatgacatccatgaagaaaattcgtctgtgaatgatattcctagccatgggctcagggttgacttccttaagccgtgtattactatgctagagcgtgaggaagaacttatttctcataggactgtttatatattacatttcactgaagaaaagtatgcctattataatttaatagctatatgcattttcacaaactgaattcacacttgtgtaaccagcacccagatcaagaaacagaacatttctgtaccctagaaaccccctcatattcccttctagtcatctccccaccctaaatccccaaggataacaactgtcttgacttttaacagcagagattagctttgcttggtttcatactttatataagtagaattgcacagtatgtactcttttttgtttggtttctttcaatattatgtttgtgagatttattcatactgttgtgtatagttgcagatcgtaggaatttctcttgatctttgtaactttggatcaattaaattgtagttgattagagacatgcccagggttgttgaatggccaatgattactatcccacagggtgaataatctcttttctccctcccttggggcattcccatgtaggcagaaaactcttaaattaggagctggttggcagatcataaaaatagattgagccaagcaccatggatcattcctgtaatcccaacaactcaggaggtcaaggtgggaaaatgcttgaggccagaagttcaagaacaacctgggcaacataacaagaccttgtctctaaaaaaattttaaaagttagctgagcatggtggcctgtgcctgtagccacagctacttgggatgctgaggtgggagtattgcatgagcccaggtgtttgaggatgcagtgagccgtgatcatgccactgcactccagcctgggcaacagaacgagaccctgatagtttgaggatgcagtgagctgtaatcatgccactgcactccagcctgggcaacagagagagaccctgatggtttgaggatgcagtgagctgtaatcatgccactgcactccagcctgggcaacagagagagaccctgactcctaaaaaaaaaaaattgattcattctcttttggctgggtaaagagcctctctgctttctagtaatgggcaaacaaacattcttcataccacaccccagttttttaacctcttttgtttagagtgtcgttgcacatgaattagaatcctactggttaagatatagtatcagataagagtcctaaggaatgtcctcagccattctgtagttacatgaatcttcccggggatttgctttgtgctatcagaggagatgccttttccaagtgaccctttctcttgggcctagctctgctcttaactctgagaccttggacaatgacttctttctgtgcctcagttccctaaactttaaaaaaagagtgtggtctatgtgatctccatggtgccttccaaattcaggataccacagttctgtgacgataaggggatcctacactgggggcttccttctggttgttaggttacctttgttaaattgtgataggtaaattgtaatcccacagataaggacaaacaaaagtggatataggtgtggagagggctagcttaagcaaatgaagaccagatttcttgaagaatgaagcattatttcaggtgctgatatctacagtgtcagcaatgaagaaataccaaattgggatccaaatacataaaatagatatgttttaccagtaaatttggttccagtggcaaaaggacccatttctctggggacataggcttagaaaagataccttaatttgtggtatggctgtacacacctgtgctttatgtgaatttgggtctgtttgtcactagcaaaagtcatttttaaaaatctttttttaatctataaaacttaatgattcactgcaaaaattatgataatagaagtcattatattttgaacctctatgtgccaggtattgtgttaagcactttatatgtattatctcctttaatccttaccataattttataaagtagttactattgtcatcatcgctgttttatgaaggaagaaactatggcttaaagagattaagcaggccaggcacagtggctcaagcctgtaatcccagccctttgggaggttgaggtgggaggatcgcttgaagcaaggagttcaagaccagcctgggcaacatagcaagactctgtctctacctccctcccccacttaaaaaaaattagctaggcatggtggtacacacctgtaggcctagctacccaggaggctgagacgggaaggatcacttgagcccagaaatttgaggctgcagtgatctataatcatgccactgtactctagcctgagtaacagagccagaccctgtctgtttaaaaaaaaaaaaacaacaaaaaaacaaaaaacaaaacagagggctgagagcggtggctcacgcctgtaatcgcagcgctttgggaggccaaggtgggcagatcacctgaggtcaggagttcaagaccagcttggccaacatggtgaaaccccgtctctacaaaaacacaaaaattagccaggcaagatggccagtgcctgtaatcccagctactcaagagattgaagcaggagaatctcttgaacccgggaagtggaggttgcagtgagcagagatcatgctgttgcacttcagtctaggcaacagagcaagacttcgtctcagaaaaaaagaagagagagagagattaagaaaaatgaaatgaagctaatgtttaactccagtcacctggctctagaatccaacgttttcatctacatactgtattaggattctctaagtatgttgtacagagaagagaaaatcctggattttctctgtttcattgaattcagatatttcacttagttatagaattaacctaatttttcttttgcacataaaccttcaaagggtatggagatgttgaacatcaacattggattgtttttcctacctggggttggggcaagcagctggaagttgggaatgaaatagggcagcatgtttatactccccaggggcaaaatatctgtgccccctgtaagagggaaacaaggactcattaaatgtgagaattggccccaaatctggctcacagctaatttagctaatttagggatgtcagggtggctgcacaattggcccctctatgctattgaacccccttaagggaggctccttgctagccctctggtttgtggtaatgtctgctggtacatattttacattttgcatgaagccatgttggagattcctttagctaaatataacatctggagaaagtagcctcctgttcacagcttaaaaacagactgactttgtctaggacgagagggaaaattgagcccgtttggtgctcctgacatctcctttcatgtaatgaaagctcagtctgtctaacctctgttggaaccagggtttgggcaaatattattgctgccaccttcatttgtttaatgcggtggcttcaaaaaccatgggcaaaaactgccaagtttgactcccatctccctgtggtctccatgaggggcatgttctaaagaagcccaccaagaacagaaataatttttcccacttgcttagtttaaactgaaataaacttgggtgtgctttttcctacaggagagaggataatcctgttttctctttttacttagctggaacacactaaaagtacctctgactttgctttctcaaatcactgtttctagcccttcacagctgctcacacttaagcttggaagctggtcagttcagacagtgctaaggctcagttgcatccttatttttacagcactgcagtgaactgtactcctgttttgctgttaggactcttaagtttctatggcaaaaatttaggttaaattgaaaaagccaagtcagattccctatagaccagtagctttcaactttgcctgggcatgaaagttacttggggagttttaaaaaaatctttgtgaccttgaataaacaaaggtttcttagaatataaaaagcatgaaccataaaattttataaaggataagtcagacttcatcaagtcttggacttttgttcctagaaagactttatttacaaaatgaaagacaagacgcagactgggagaaaatatttgtaatatgtatctgacatggacttatatcagattatagaataaagaactctgagaactcagtaataagacaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatggcattaaatttgtacttgtcatatgacccagtaattccaggtatttataggcatctacccaagagaaataaaagcatatgtctaaacaaagacttgcacctgaatattcataaagcttttgtgataggctgagtaatgcctccctcaaaaaaaaaaaaaaaagaggtccatattctaacctttggaacctgtgaatgttaccttatgcatgtaatactttgcagatatgactaatttaaggatcttgtgatggggatattatgcttaattagctgggtgggctgtaaatgcaatcacaagtgtcctcataagaaggagattacagataaaagagaggaaggtcatgtgatagaagcagagggaaacagagtcatagagagaggatgctatgccactggctttgaatatggaggaagtggccatgagccagtgaatacagctctagatgctggaaaaggcaaggaaacggattcttcctgagagcctccggagcagaagcagccctgctgactcactggtttcagcccagtgaaattggttttggagttctgacctccagaactctaagagaacaaatgtatgttgttttaagccaccatgtttgcagtaatttgttacagctgccttaggtactttattcataatagcccaaactggaaacaacccaaatgtccatcaacaggtgagtggaaaaacatattgtagtgtatccatatatcaatactactcagcaataagaagggaaatgctgatacaatataaatgagctcaaaaaacattatgttgataaaaagaagccaagcacaatgagtacattctgtatgattctgtttctataaaattttagaaaaaacaaatctgatctatagtgatagagaatagatcattgattgccttggggccaggatggggatgaaggattgactgctaagggacacaagggagtttgtagggtttttatagcctacattatataacattttaaacaatgctttataacatttttataatgttacataatcttgaccatggtggtacattagacagactttatcatattatacacttaaaatgtgtacattttattatgtaaattatgcctcaataaagttgatctaatttaaaaaatactcatgccaagaccctaccccagcatgatttagtcagaatctctggagtagggcctgggtgattgttgcctacagctagggctgagaatcactgctgcactgttttccatcttggggaaactgcagagcacagagaatatctgatgccctaagatcctgtctatctgtatgtgagccatgtttgcctctgcaacagacagtgttaaagcatctaggctagtttctctaggcaacccattgtggtttcctactttattcttggagggtgatgaagggtgaagttagcttcagataaataaatctggtgacaaagggtgaatctggcttccttcacactgcaggaagtggggaatgcaagaagagtgctgaggaaggaatgtaagaggctcagttaatacttttctccagggccttggagatgttaaacatgtccttttgccattagtgaatcagtcacaagagaattgccacaacagtcagatttcttttggcactaaggaaatgaatctggtagttaaaaaggataaatgagatttaaaactaaaagcagtgcatgttacctatctgtttggtatccatttggactgagataggatttcctatggcgtgtcttgagtccagctgtttggcatgtgtgagaagagtggatgatgaaactgtgagagggcattttgggtggtgtgatggtcataaataagaagaggagaagtggtgacccacaatgctggtatagttgaatgtccctggtaagtgctgtggattgaatgaatggaggaaaagaatggttttccaaaggttgtgtccctgtgctctgcccccttaagaaagggtttaactctttgggagaaggagtagatgagtgatttaaccctccctcccttccccgtctaccatatccctcctgctcgtctgaactcagtatctgtgattggactgaatttcctccacattatagcatggtcactaacagcgtttgcacagtgctttacggacagctgttccagttgcccagtttatcttgttggtagcaaaaatctgttctaattaattgagctttattctctcatatctgatgaaaagatcctctttggagaaaagaatagaatgtgaagctgagcttatttgagtaggggatggaaggctgccagctacttcaaaggtatctctgctgataaggggcgtcaggtttgctgccaaagccaacaccgaggggagctttgcagctcgtgctgttgggggtgttttagctttggtttctgtgacactgggtcagcagcatctgtgtgctctcccttgaggctgctctctgggtggtccaggcttttatttagacttcggaaggtgcagctcaaagggaatgtgtgcatcaaagatgtctgtagtcttttgcttaggttagtttgtgtgtttgcctttttggtgttttagttcttaggtatctaccttttctaaaagagctcaaggtgctatatttagaactttcaaaagtataatagtacttcgatttgtataaatcaaaggattattaagggaatctgaagacgaggaatggaatatgggaaatggaatatgggaaagagaggtgcagtagacaaaaaataaaagtgtccatatgcaaccttgtattggaatactaccctaaattaggagattatacagtcaataagtattttagtgaatactgcatgcacagcattatgctgctaggtgcttaaaagagcttgaaaatcaaattgaggagtaagatttgcctcccaagggagcttggggtttttggtttatttaggtctctcaaaactttctgtgggatgatgatgatgacaaagtaataatagtaacctttcgtaaaattcacactgtgaatacctcccactgtagtaggccctagatgtgtattttctctgaacctttcatctatttttgcaaagtttttttcctaaactatttatgaaagtataaaatacttagagaaagtacacatattataaagtgtacagctcaatgaatttttacaaactgaatacagctatgtaatcagcacccagatgaagaaagaatgttactagtatcccatgaaccctccttctctccacttcaagtcattactctctgaagggtaaccattatcctgacttctaacacaatataagtatttgcccatttaaaaatttgtttgtgtaaatggaatcagataatttttttcaacaacttgaatatgtaattcacttgccttctggcctccattatttctgatgagaaatcagctgtggttcttagattcttattattgcttacttgtatgtaatatatcatctttttgtttgtttgtttgtttgttttaaagagatggagtctctgtcccccaggctggagtcctgttgcatgattacagctcactgtagactcaaacttctgtgctcaagcaaacccagtccttccatcttggcctcccaaagtggtgggattacaggcgtgagctgccatgcccagcccttctttatttggctgcttccaatatttattcattatctttggtttttagttctttgattatcataagagtgtaagcgtggttttcattgtattcctttggcttggttaaatataatatccagacaatccctgatctgtcaaatatctaatttgtagaaattgtaggaaaaatatcaattttttcctcaatttgagaaaaatttttggcaaatatttttttctgtcccatctctccttcctgttttgctttgttatcaattgcatgtatgttagactacttgattcagtcccacagcttgttaatattctgtccatttttttcaaatttttgttttctgtatgctttagtttagatgatttctaaagtttaccaatttggctgggcatggtggctcacacctgtaatcccagcactttgggaggccaaggtgggtggatcacttgaggtcaagagtttgagaccagcctggccaacatggtgaaaccccgtctctactaaaaatacaaaaattagctgggcatggtggtacgtgcctgtaatcccagctgctcaggaggctgaggcaggagaatcacttgaacccagaaggtggagtttgcaggaggctgaggcaggagaatcacttgaacccggaaggtggagtttgcaatgagctgagattgtgccactgcactccagcctgggagacagagcaagactccatctcaaaaaataaataaataaataaataaataattaaaacaaccaattctttcttttgttcacctaagatgctataaatgccatccaatgaattttttttatttcagatttttttttttttttttttgagatggagactcactttgtcacccaggttggagtacagtggtgtgatcatagctcaccgtaccctcagactcctgggctcaagtgatcctcccacctcagcttctcatgtgtctgatactacaggtgtgtaccatcatgcttggctaatttttttagagatggggtctcgctgtggtgcccaggctaggcttgaactctggggctcaaatgatccttccccttcagcctcccaattattgtatggatatttttaaaacatagttggcaattacttaaaaatccttgtttgctatttttaacattgacattatctgtgggtctgtttattgattttcctcttgacttttttttacatgcctactaatcttttattgcatattggacatcatagataatatgtcatagaaactctaggtgtacttatcttcctctgaagagtatgaagttttattctaggaggctattaaattactggttgatcaccttgatcttgtgggggcttggctttatacttcattacagtgggtatattttggttttgcccttcgtcttagaaaatactgtataattaaggcatggcctttctggggttttcatgggaagcccaagatgtttatcaagcccctctaacttggcaggctttgaatgccaaattctatcttccttacagtgggcagcacctaagacgaccaactatcctgtttgccttgggctgagggggttcctaggacatgagacttttagtttatctgttcaattgttgatggcatttggatagttttcagtttgaggctattatgtatgttataaataatgctgctatgaacattataatgggaagttattctttccaatgtatggttgaacctggtcacaagccaggctttaagaatagtgaattcaaaaccttttctctctctttctctctctctctccttctctccctcctctgtctctctccctcccccccttccttctcccctctgccttctcttccctctcctttctctcttccttttcctctttccttctccctctccttgtttcctccctcccttccttttctctattcttttgaataatcttttaaattttatagtagatgtatgttatagaaaatttaaaaatacagaaagcaaaaatatgatataaagaacagatttattgtacatactattttgtaatctactgttttagtcaagaccttctcctttacatttcaataaacttttgtctcatctaatacccaggccatgttaaagatttaattaattactcaaaaaatctctttgacaactagtttgtccaagccagtatctaatgcacacagttttatgtcccttaagtgtactttaatctagtattattttctttccatgaaactgatttgttgaaaaggccaagccagatgtcctgcaaaatctcccatcttctagatttgtttggttgtttacttgtgttgttaagcttctgcccgtatcccatatttcctgtaaattggaagttggttctaaaggtccaagtggattcaagtgacttagaatgcataataagtgatgttagtacttcatgtagcatcagagcaggaaatacataacatctagttagtctaccgatagtgatgctaatattggcaccctctagaatagggctgtgatagtctgacccttccattttctagttacattttttaaatcacatgatagaaacctgattgtaaggtgttattcatggtgccagcctacaaatattgggtgccagttcagtcattcgtctgataattttagtatcagttgataattttagacaagttactttttgtcatctttgtacctctcttacttgactataagatgcctctctgaggctgggcacagtggcttatgtctgtaaccccagcactttgggaggcggaggcaggtggatcacctgaggtcaggagtttgagaccagcctgaccaacatgctgaaaccctgtctctactaaaaatacagaaattagccaggcatcgtggtgtattcctgtaatctcagctactcaggaggcttagggaggagaatcgcttgaacctgggaggcagaggttgcagtgagccaagattgtgccattgcactccagcatgggtgacagagcaaaactccgactcaaaaaataaataaataaataaataaaataaaaatgcctcctgagaaaaggagaggattgttaatacagctcatcaggcaccatgcaaatagtagtttgtaaaaacgtattagtcttgggagaaaccacacacacgaatagtgtgcaagctgactaggtgtcaatttgttattattaagaatcacagcaataatttttttaaaaaaagcataattctaaatgaatgctaaccatgcctagggactgtgctaggtgttttacatgtattaacctatttaatctcatcacaacgacactttgagatgagtactggttttatcatccccatttgtagataagagcatgggcaaagggtttaagcaatttactgaagattatacagctggttgatgggagaaatgggattcaagcctaggcagttggcttcccctgatctcttcacatcatcatgctctgctgccttgcatgtaggaaggtggcagtcatattggtaagctaaagaaccagtgcttgtgcagggaattaatgactcatgcattctgcagtcatatgttgctgtgcttctgtcaggtcagaatttccattgtgctattctgattctgcttcttgcccagcttgtccagagagagagtagcacctttgattttagcctcccttgttgcaggacaggcttctgttgactcccctatttatctttgtcaagacttttcctttgaattcctccctgcttgtctgagcatgatttttatttaaagtgaggacaaaatttaagttttcctccttttgacacagcgtcttcagttttttttcattttcatcttctttccttacaatactggactttctctggtcttttagtttttctactagatcctacctttctttgcttttaagcccagcccttggggttttttgttttgttttctttttttttttcctttttctctgttctctacaaatcatttgggtctacatccagcttctcccagcatttactcaatatgaaacttccagttatagattaatttgaattctttgcactaattgtttaaaagaccataggaacctcagaccatccctcttcatggtctcaagagctcccagaatcatcctcttggtaagctaagtagttattagtaaggcccagggacaggactgagaagtaacatcttctattttttatttcagttttcctttaagttggaagcaaacaaacaaaaaacccttcagcttagggttttttcaattgttaaagtaatactgagcttcagttaaggctatgaaagaaaagaaaaaattttaaaaagtagtaacgtgtttttttcaagatattgtgggtaaaaacataataaaaagaaaataataattacttggaatcatgattaacattttgatgtatttccttccaatcttttttatacacatttttttaaaaatgagagttacattatatattaagcttagtgtaatttttttcatttaacatttggagaagcatttttatcatgtcattgcatcttcttttaaatgttgcctatatgatcatacagcagtctgtagtctggctgtcccttaggtttttcatatattccttatggttctttggctatgttgtctttttttttttttttttttttttggagatggagtttctttttttcaggctgaagtacagtggcgtgatcttggctcactgcaacctccgcctcccgggttcaagtgattctcgtgcctcagcctcccgagtagccgggattacaggcgtgggctaccacatccagctaagttttttgtgtttttttagtagaggtggggtttcaccatgttggccagactggtcttgaactcctgaactcaagtgatctgcctgccttggcctcccaaagtgctgggatttcaggcgtgagccaccacgaccagctggctgttgtcttgactctcccctggactatgttcttgtacatctagaagcaattaaaaatctcattgttgtctttttggaaatcacttgtttttaggatgactaggtagccaaggctttcatttggaaataccctacttccatttaatataaggtaaggagagagggtttttccccctgctgctttccctttttcttcctcttctgtcttgctcattgtcttagagcttagctgagaatcagtgctacgcctgagcttgggccctggctggctcagtggagttctttcaccatgctgagtttcactttcctcatctttacactaatgaaattactcataccctcactgttccttctcagaatgctataggcatcagtaaaacctgggaacaaagtgctctgcaaagttatgttatggtcagaaggtatctggttgtgttcatgcagaagagcgtgtgtcttgtgccttcgcccagctagggtggtctttgcaatctctaagctaatctttttttagcggtatattatcatataggctagaaaggaaatacagagaacaaactgggagatccagtctccaactttaatcatctcttctccaaagccaagataatccaagccttctgcccacataagcattgcatcccttcctgccttgcctcttcccatgaccttgtttttcttttgatgttcattttgagggtggagagtagaaaaagcattctctttttgctgctctcagagtcagtggtctttctggacctttaagttctcaggcaaggaaaaccacatagtctacctgagctttcagggactgaaggaaaaaaaaaagtattgctttactcaaattcaggaccacaaataaccactaccaacccattcagttgagtttaataatattattttattgtctgtaattgctcggtattcaagttggcagtataaaaggcctgcagagcaagcttaaaacatggttcaagatcttagatttcttacatctcaggtgaaagacagaccatagactcccaaagcaggttacaatttagatagcaatgtaatgagtcgtacagacaatttgttgtctataggatcttggaaaaaaaacagattcatgaaaagtgagtcaggagagcttcatagaggggaaagaattgggccgatgttcttttaattacctgctgccaggattctcaattagccatctgtttcttatcttacagaaatatcttttgaagatttccatattatctgattccaagttcctttcctgcctctttgtccccattagagatgtcactcatgaggacagtctgacagcagagacttccttttgaccagcaatgggagaaatatgtggaaatagcctgaagcctgagtatagaaggctttgaatgccagtccaaggagttcaaactacaggtcaaagagagccattgacaattttaggcagggcaatgaaatcttgaaaaccatgatttccagtggcattggcagcagtactcagtgtggtttagcatggaagaaactatataggagcctgctacaataattcagagggataatagaaacttggataatgacaatgggaactaaaagaattagatttaccagaaggcagaggaaagacattatagacaggactgagtggcctgacatgaggtgggaggaggtcattcaacttagtcattcagcagttcacttagtcattcagcagatatttacagtgtgcctcccatgttccaggcactgtgctaggcactggaatatagcagataacaaaaagttcttgccttcatggagcttatattctaatagttgaaacagataatacataaaaaagtaaatatataatatatcagatgatgataaaatgaaacagggcaaagaggatggggtacaagggatattgctctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatattgctcttttatatagggtggtcagagacggcttcactgataaattggcattggaactgattcttggaggaaatgagggattttgctgtttagctctttgaggaaggtatttcaggcagagataatagtgcacatctaaggccatgagatgggaatgcgcttatctggtttgagaaacagtaaggagaccttgtacagagtaggcaagaggaagagtggtgggagatgtggtctggggcagcgagcaggtttcttcaggaagggccttggaggctactggaggactggagaggcatgatacagtctgacttctgtttaaatgggattattccagcttctgtgtgaagagagtgctttaggaggagtagggtggaagcagcaagggaagaccaattaagggagcttctataaataattagggcaggaaatcatagtggattgaaacagggtggagctgtggagatggtgagaagtggtcaaattctgggatatattttgaagatggagccaataggatttgctgcttgattgatatggtgtatgaaaaaaatagcagtcgaagatgaccccaagcattctggcctgaacaattcgaagttggaattgccatttattgagggaagtgtgtggaagagccactgattctagtcaagccctgtaattcatgaagaatctgagagccaatgagaagtaacttgccttagtttacccagttaggtagtagttgagatgtgactgaaactaccaggtcttctaaattctactcactgctctgtccagtacataccatatttctgacttcagctttagacatggtaaagggaaggtttagtgagggcaagagctagaagaagacttgaaaattaaccacacaaaagaccagttgaggtcatgaaagggtattcagagtaaagggtagttgaggcctagaaagaagactttgaagagctagcaaagaagagagaagaacaaattaaaatgggcaaaaggaaaatgagagtaatatggctcaaaggacttaagagagaagaagactcaatgatgagttctacgaaggggtcaggaagaatgggaactgaacaaatgtcattagatttgggttttagaatcttgggaaactgtggtgcctacaacttaacctcctttaaaattttaagcacttttcttgccgtttcagctaataaggagaaggaatataacagggtaagcctgagacagagaattaaaaacaaatttacttccaactcctgcattaccttcttgtgaatcctacacaagaatttgactttcccagactcccatatgcccatctataaactgaacaagaagcatacttcttgcccactttgcctcctggagatcctgtgaggataacaatgacaaaggataggaaactgctttggaagagaaatgctacataaatcaagatatccttttctagctgactttaagtttttaatttaagaaaaattcttgaaagagtcacaaaaaactttagagatacactaaatgcaggacgtgttgactgataaaatagatattcttcttggaaacaatggaaaatacttcagtatcattttgattaaatcttgcttaataactgttcattagactcatatcaaatcctgtcttggctttgttatttaatttaatttaattttgtagtcattgttacccaaccacaaaagaattacccctgtgcttaaggccacacagatttttcaaacattgatatatcagcattggtccttctgatgaaacacaagatgaggttttccctgctgagtgtcaggcagtctgtctcaagctgcaggctgaagccccagtggaatctaattccatccttccagtccccttcatacgaagagtgggaaatagtgggaatggaaattaattgtacctgctggcattattaaagttatcagtgcgtatcccctcttgggccaggaagattaaaaaggctgttgtaatcagagcacatgatttctgacacactggatgggcttcctccccaggttagatgtaaggaagtgatctgagcttgttgcctctggcctgataccacatagctcggggctatgcagtgtctgcctcatcctcccatcagccctggaggaaagccaggatcctgctctctgaatcagagatctcttagttggaaaatcaggccttctcacttaagactagtgtattctggctgcgcattcctcacaagatgtagtcaggttaggttagaccttagagtcacaccttgttcaggttcaacctgagtgaaataaggaattgaggtgctgctccctggtgattcagctcattttagcaagtgtttattaaatgctttccccaagcaccacaccaggcccagacaattctgcctgtacacatcctgtggtatttgttggttggaggaaagaggctcttgtagtttatgaattaaagaaaaaaaattcctgatctgggaatgagaatcttatcctacgtttcacactgactcacagcctaactttgactgtgaatgccgcctaactttgtaacctgtctaggacttagttttctaatctgtaagataatggtttggactaatctctctaagatttatctctgaaattctgtaattaagtgagggaatttctatgaaagtgcttggcaaaccattgggctattatgatagttctaagtggaaacagtatgtttcctcaatacacagtgaattgagttctgactctctggggcagatagatttctgactttctgggccatgtgttgagaatatgaagatggctgatgtggcccctgatattgaatacagtgtctagtgggagaaatagacatgcacataagctatgatgatacagtgtaataatgggttcttgggtggagggaaatatgaggtgaggtttgccttatgatgtcctttgtatcttaggaagaatgggagtgtaggagaggggagcataggggatttctgggagataaaaccatttatgcagaaagcaaggaagtataatagatgaaaagcgttccggaactacaggtggtgtgggtgaggatggctgcacacaggtcccttgtaggggagtggcaagcgatgaggctgaggaggtgggcagggccttgcctgccacatcaaagggcttataccctgaagccagtgaagcagaagcccctgtaatgttattgttttaacttcttattttgagataatttcagacttaaagaaagattgcaaagtagtccagaaattcctctgtacccttaacccaaattccccaaatgttaaaatcccatctttccaatatttgggggcgagatttttaaaaaatctcgtataagcacagtacaatgatcaaaatcaggaaattaacacggaggtaatactataatctctcaatcttactgaaatttcacttgttgccttgctaatgtccaattcaaatttctggttcagggttcagtttaggatcacacatgatgtcgaggtgaactgtcatcttagtatcctctaatctctgacagttcctctgtcttgctttgtctttcatggttttaaagagttctggtcagttattttgtagaatgttcctcaattttggtttgtttggtttcctcatggttggattcagtttaagcaattttggcaagaacaccgtagaagcgatgtcatatttttcttagtgcgttatatcaggaggcacttgccgttgatttgtccccattactgacggtgataattttaattactcggtgaggatgggtgtcccctttacagtgtaataaatgtcttgtgaagatactatgtaaatatcctatttctcctcatcttttgcttactaatttttagcatgcttgttaactgaaacaatcctactagcggattttaccaagagagtgccatggacagatttgccttttagaaagattactctgaaatgtttggatgtgagagagatgtgagaacagggaaaaagttactacagtagttcattcaagagcggggccctgatctaaggcagtgagaggaggagtagagaagacagaagagccatttaggctatgtttggaatcaataagcagggtttacattttgtgctatagatttaaatgctggaaaaattctgaaatggggggaaatatcacattttttatagattaacaggcatctatataacctctgggttgctcttcttttttttttttttttttttgagatggagttttgctcttgttgcccaggctggagtgcagtgcgcgatcttgactcactgtaatccccgcctcccaggttcaagtgattctcttgcctcagcctcccgagtagctgggattatagtatgtgccaccatgcctggctaatttttgtatatttagtagagacaggttttcactatgttggccaggctagtctcgaactcttgacctcaggtgatccacccgcctcggcctcccaaactgctgagattacaggcataagccactgcacccggccctgggttgctcttctaagaatagctgactttattaaacatattgtaggtttcattaaatgatgtttcacaaggtgttgcttctcctggaccaaattcctgttgttcagctgagagctatttctaatctccagtgtggatgtgctcatcatttggttataggatgtgagcaaatgagatggtgttctgcgtagcccagaggctgcttccattagccctttcccgaaacttttgccactttcaggcttagcagtatcctctcttgggttcagaatgcctgctctttgccctaatacaaaacctagagctgtaggccatgttcttatgatttgacagtatcagggaagcatttcttattgacttttccagagaaagagagaaaataagcaagccggcaacaagacagaggggaaaagggaagtggctcagttcttactttaagaaacaacatggaagatatgtttgttgatttgagggtggtgaatttttgcactatagctttgtgagggagctggaaagagcctttcagtttttcatgactgggagtttaatttggtttataacattacttaaagataactttgaaattggtctaagaacttagggttgttcctgaccccaggtcaatggcctacttgacctaggcgagaggagaaagagttaaggatagggagttgagctttttgctccaaaatctatagagggtacacccctcttatattctggagtcttactgggtttctgaaaatgcccttgtgggtcatgaaacaatagtcctttgaatatttttctgccgctgctgatgtgagctgcttaaactggcaggcagatgatggaaggaatggttacatgtcccaggcgggaggtcatgacagttggatctgtggttgacagaagaatttcaacacacattcaaatcagctcctaagatagattgtctgagttccctgggcctgcctcatgccctcctcaaatgcatttgactccttctggcccgtaatactcacacttcaaatgtttggcttggcgtccacaaatcaactcagggccggggtaggggtactgatgagcagtgatgccctctttgggagctaccacagcataggaaatgaacattagaccaggaatcaggtaacctggttggggacccagggctctagatggtttatttttttattttccttattggttaaattccctaccgcagttttgacattctcttctggatactgactgtggtctagagaaacagctaaggaaggcaaatctgaattaaaatctggttcttgggaaagaactgaagttttcagattttgcaaaattatggagagtgcagactaggagaaaaaggacaggcatagttgtgacaaggagctcttttttctagttctgcattctagaaacagtactgatgagtccaaaaatatagagataaaatttgtcttttttcttgctttaaaaaagaaatgcttctaaatgtctacatacttgcctaagaaaatatttctcaactcctccagaatatttagggttaactaaaaattataaaaacataccacagagctagtccactctttatgcctagggtttacccaaaaggtgtgcatgctctggcttggagaccctgaccccatctcaacttgctggtttcaagtctacatatttggctgcaaagccctaatgccaggaggaatgcggaactgatgagtccaccccatctacaagctagaaggacatcttgattaaattagtgtcaaggggggtggagagaaaggcacagtgacacaaagggtgttttgaggagccctgtagcgcctgtggagaatgaatgttctcgttaaatatggccgtgacctgcagctccacacatgccagagacacagctcaattgtccccaggatttggggggtggggacgatcatggggagaggacagcctggcatggaaaggcaggaatgcaggaaggcctgttgttgttttctttttgcgataactacagcaagcaattctttgatcatggtccttgtgtttgtgtttggaagggatcaagaagcgatttcctttcccctgggtgtttgaacctttgctctgctccttgcttctctgggtattaaggggactcctgaaagcccccattgtcttcagcctctttccacccccttccttggggctccccaagaagattgttgcctgaactctgtagggcaagaatgagaagcagtgcccccaagacagtgcctacccttgtcatttacccaccatcctcatctcatttatccttaagtcccaagaccaaagcaaagaacacatgggctgttgaaggcttccacaggactgccctggtcagtgggaaagcagtaatgctttctagctgggtaaccccttggctgagttccatctgcactgtggccagggtgcgtggtgagacatgcttttgccatttgccctttgaactgccaacaatcccaatgtagcaaatggatttaaagctgattgagttttagatttctttcctttaaccagaatattctagcagcttatttttatagttctgcttatatgattctctttttaacagatggaatcacaaccttttctgcagtatatatctgatgaatttaaaaactgatacatcaagaatattcttttgtatatgtctttcttgctgtgaaaatttatggcctttcttccccctatcttcgctctgtaattattaggtgcttactatatgcaaggtattgtataagattaggagaatacagataagacaaaatagcattgaaggagtttatgagttcaattccaacttcaccaattaatagttgttctcatggacaaattttttgacctctctaagctttagcgtctgtaagtactaagtgctttttgtgcagagagatgtagagaggtgaaatttgagctgggtttttagtgaatgaaaatgatttcagtaattaaagatgaaaaagtacggagtttgtgagcatggagggggagctggagtcaaaggatattccatatggaagaacaggcttcaggatgaaggagagcaccggaatgtgtgaggactcttcagagggtggtgagtaaaaatagtttggctaaatcagagtgttaatgaggagagcagcttgaaacaaagccgaaaagagcctcgaatgccaaacttggagtttgaacttcattctgagagcactagggaacgatggaagacctactcatagggaaatgataaaatattgctgctatttccgaaagactgggcctctaattccaggacagggtaataagagcctgagatgtggtagcagtgacaggaggaatgaaaagaaggagacagatgccagacatatcatgaaggagaaatgaacagcgtatggccacttattggaaagagaattcgaagtcagcgattacttctttcaatttttttatgctagtgccacttaggaaaagccagtgtgctgttacagaatttgaggtggctggtgaagctgacattttcacatatgtctcaggaactagatgcccaaatctttctcagaccccagatggccccatatagagcttttatacgtgccaatttttagaatttcttgtagagttcctccatttggtggtcaccagaggatctctgagattagtatctggattcttaatcattcagctaatttcagagatgtcctttatttgaggtagatttaacctcctttttctgtttgatggagtgtggtttttgaaaagtccctaaggaagtaacgtgaaaccatacttgaaacctcaggcttgcttctctcttgttttaccagaatgctttggttaccacgtcctgggaaatgaacaacttaaaacgtaagtgtggcaagccttcactatcaccagtatctgttcattgtatcaaacaaagcatatttccattcttattaggtttccagaattgcactgggcctggtgagggctacaaataaacataagataatctgttttcaaaatttaaacttagagttgtgcttctagaaatggaagcttttctagaagaaaattcagaccaatccttttgcttcatgggagctgctttccttgaagaggcttctgccattttagaaaatattactgagtgtcaaaaagctgagcagagtgtttaatagacttgtagggctagcaggacaaatatgggaatttaaggcccaggggcccaggatgggtagccttggtaaaattccccaggctttgagacaccaaagggatacaattaagaaggaaagataagccagaaatagactaaggcagtttcatagagactgaagcctggattcaaattatcttaacctctaattggattaaggtgatttaggatagccagtggctagaaacaaatttaaatcctctctagaggaagatactgtggaagatactatcatcctagacctaatatatctctcatcatttttcatcatgatgtttggcactcagttataaataattaggcctatgaggaaataagaactgtgaccaaaagctaagagaaacagctagacccacaggagatcctagtaatggtgttaacagatgcaaactttaaattaactatgtttaatatgtttatgaaattaaattataaaaacaaacctggaaataataaaaaaaattaactcaaaatggatcaaaggcataaatgcaagagccaaaactataaaactcttagaagaaaatataggtgtaagtcttcgtgatcttggattaggcaatgatttcttacatatgacaccaaagcacaagcgacaaaagaaaaaataaataaattgaacttcatcaaagtcagaaacctctgtgtttgagaggacactgtcaagaaaatgaaaagacagctatagaatgagaaaaggtattttcaaatcatatatctcatcaaggtctaattttcagaatatataaagaattcttagaactcagcaacaaaaagatgaccagtccagtttaaaaatgggcaaaagacttgaataggcatttctccacagaagttacacaaatggccaacaagcacatttttgacactgttatttattgggctactgcaaatcaaaaccacaatgaaacaccacttcacacccactaggatagctataattttaaaaaggaagaaagaaaaggaaagaagagttttggagagggtatggaggaatcagaaccctcatacattgctggtaagattgtgaaatggtgcagatgctatggaaaactgaaaattcctccaaaacttaagcatagaattaacctgtgacccatcaattccacatctaggtgtatacccaagagaattgaaaacatatgctcacacaagaacttatacacaaatgttcataacagcattattcaaaataaccaggctgggcacggtggctcacgcctgtaatcccagcactttgggaggctgaggtgggcagatcacgaggtccggagatcgagaccatcctggctaacatggtgaaaccctgcctctactaaaaatacaaaaaaattggccaggcgtgatggcaggcacctgtggtcccagctactggggaagctgaggcaggagaatggcgtgaacccaggaggcggagcttgcagtgagcagagatcgcaccactgcactccagcctgggcgacagagcgagactccatctcaaaataaataaataaataaataaataaataaccaaaaagtggaagcaacccaaatgttaatgaagtgatttatggaacaaacttaaagtatggcatacctatacaatttaaacaaaatgtgtcatgtccatacaatagagtagtatttagtcataaaaaagaaggaagtgctgatacatgctacaatatggatataccctgaaaacattgtaagtgaaagaagctaaacataaaaggccacatattatatgattccatttatagtaaatgtccagagtatgcaaatctatagagacagaaagtagattagtggttgctaggagctgggggaaggagagatggggagtgactactaacaggtttgagttttcttttggcatgattaaatattcgggacttagtggtggtggttgtacaaccttgcaaatatactaatagccactgaattgtgtaccctgtagtggtgaattgtacagtgtgtgaattatatctcaataatttaaaaaaatcaaacaaattttagtacaaaaaatgcagtaactaaaagagctcaatgtgtagatcaagtagcagattagatggtgctgaataaatagttaatgaactgaaacgtcagaaaacaatgcatactgaagctcagagagataaacagatggaaaatacagaaaagagcataagagacttatgggatagggtaagtaggcctaacatgcttctacttgaagtctcagaagaagagaacaaagagaatgggatagaagcaatatttgaagagataatggctgtgaatttccctaaactataaaagacttcaagccacagactgaagcattatgagccccaaacaggagaaatacaaagaaaatacaaacagctagaggtaaaaaagacgtattatcttcagtggagcaacagcatggttgacagctgacttctgaacaaaagcaatggaaagcagatgacagtggaatgaaagtgtagaaaggaatacccttcaaaaatgaaggtgaactaaagatgttttcagacaagaaaaatatgagaaaatatatcgccagcagacttgcactaaaagaaatactaaatggcattatttaggcagaaggaaaatgatcccaaatagaatcttagaagtgcagtaaagaatgaggagcaacagaaactatatataagaatatagattggccgggcacggtggctcatgcctgtaatcccagcactttgggaggccgagacgggcagatcacgaggtcaggagattgagaccatcctggataacatggtgaaaccccatctctactaaaaatacaaaaaaattagccaggcatagtggcgggcacctggagtcccagctacttgggaggctgaggcaggagaatggcgtgaatccgggaggcagagcttgcagtgagacgagatcatgccactacactccagcctgggcaactgagtgagactccgtctccaaaaaaaagaaaaaagaaaaaaaatatagatctaagtgaataatcactgttaaaaacaacactaataatcatctgtggggttttccttttttagatgtgtgggtgggagggacagagtcttgctctgctgcccagcctggactgcggtggcacaattatagctcactgcagccttgaactcctgggctcaaatgatcctcccacctcagcgtcccaagtataacagctgggacaagaggtgtgtgccaccatgcctggcttattttttattttttgtaaagagagggtctatctgttgcccagcctggtcttgaactcctggcttcaagtgatcttcctgccttggacttccaaagtgctgcggttacaggcatgagccaccacaccaggccaaccctgtggggttttaaatatgtataaaattaatataaatggcaacaatgaaatcaacaatagaatctgtgtctgggtgggggtagggaaatgggtttaaagatattttcagaaagtggtaaaagtagtaatttgtattaggtgttggcaattcaaggatatatgttgtaatttttggtaaccactcaaagaatagtattgtaccaatctaagaaagggacaaattcagttaataaaaaagtaactcaaaagaaggaaagaaaaattctggggagggcaaaactatagagatacagaacaaatcaatggcttccagtggttaagggtagcggagagtttgactctaaaggtgcaggatacaagaggtttttggtgggtgatggaactgttctgtgtcttaattgtggtgatggttagacaactctgtgcatttgccaaagcacatggaactgtatgccaacaagagtgaattttctgaatgttttgtaaatggaagaaaaaaagaaggtaggaaaggagaggaaagaggaaaatagaagaggcaggacaaatagaaagcaattagcaagttggtgggtttaaaccataatataaggtgtaaattgacttatgcaaattaaagacagatttttaaaaagcaaaactagagtgtatgttgcttgtaagagaacagatacactttaaatataaggataaagaaagatttaaagcaaagtgataggaaaagatagctacaataaaatcaggccaggtagattcctttctttctttctctctcctttctttctttctttctttctttctttctttctttctttctttctttctttctttctttctttctttcctttctttctttctttctttctttctttctttctttctttctttctttctttctttcttttctttctctctctctctctttctctctctctctctgcccccccacttctttctttctgtcctttttttttcttttttttttttttttttctgagtcttgctctgtcacccaggctggagggcagtagtgcaatctcagctcactgcaacctctgcctcccgggttcaagcagttctcccgcctcagcctcccagatagctgggattacaggcatgcgccaccatgcccagctaatttttgtatttttagtagagacagcgtttcaccatgtcagccaggctggtctcaaactcctgacctcaagtgatctgcccacctgggcctcaaaaggtgctaggattacaagcctgagccaccgtgcccaggcagtccaggtagatttcaatgcaaaaagtatttttcgttataaagagagacatttccaggctgggcatggtggctcactcctgtaatcacagcactttcggaggccgaggcaggcagatcacttgaggtcaggagttcgagatcatcccggccaaaatagtgaaactctgtctttactaaaatacaaaaaattatccaggcatggtggtgaacacctgtagtcccagctacttgggaggctgaggcaggggaatcacttgaacccaggaggcggaggttgcagtgagccgagatggcgccactgcactccagcctggtgatagagcgagactctgtctcaaaaaagaagagagagagacatttcctagtaaagactaagtttccaggaagaaatatatacttaataacataggcttaaaatatgtaaatcaaatgggacagaattaaaatgggaactagataaatcatcaccccaatgagagatttaacacacctgtctcagtgaatgattaaacaactagaccaaaaaagtcagtaaaaatacagaagagttgaaaaacaacaaacttgacctaaatgacatatatggatactgcgcctgacaactgcgggtagatacacattctttttttttttttttttttttttttgagacggagtttcgctctgtcacccaggctggagtgcagtggtgggatttcggctcactgcaagctccgcctcccgggttcacgccattctcctgcctcagcctcccgaatagctgggactacaggcgcccgccactacgcccggctaactttttttttgtatttttagtagagatggggtttcaccttggtctcgatctcctgacctcgtgatccgcccgcttcggcctcccaaagtgctgggattacaggcgtgagccaccgcgcccggccagatacacattcttttcaagtgtacgtggaacatttacaaagtttaaacctgaaatggggaggaaaaatcgaagagcttaggggagaaattagagctggagattggaaatctccatttccaaagtctaccttctttttctcacaattccatgatttttcagtaggagtggggtactggccaagagggaaggtatcctcccccaagaatattgatttttcttttttcaactgtatgtaggccatgactaatgggaatggctacccatgtgtttactgtggacaaagacaagaggcttcaaaccaccattgtagctgaagaaagctgatacaggctcaaatcttcatcccagtccctaggcaatgcattctaatttctgtcagtaaagggctctactcattctcccaaagttggctttgtgctcctcttaggtccaaccctggcacctgaggtgtcaagaaaatgctgtcttcataactcactggagcctcttcctctcgattctaaaggctactcccagtgttctaaaactacacagatctctcgatgaattggctttgctgctgggttcctctttcttaaaagtatttaatcagcgattttcccagtgccccaggcatttcctgtacgagtgctgctgactgttttacttcctaccaggctgccctcctcctcttggcattcacacttccaactttcagatgagctctattaactcctgttcttccagcctccgcctggctcagccatctgggagccacacaggcattctttccatcccccagctcatagatttccttattgtagaagggcatatgttttcaagtaccttatcattctggctctttcccccgattctctcccagttccaagccattgattgtttttcctccttagttcattttacagctgctgagagatttgtgctctcgtgctgcctgtttgcttttgtgtcttttgtcccttatgtcccagtctactcaaggatacccacagtcacctagataccatttctactctgtgcttttagtgtcctgcttgggaaatggggtgatcactcatcttcagaatgacctcaagaaatgctttggcatgagagatcagggcctgaagacattacgcccccactcaaatcattatccaaaagggtaaaagatggaaatttgccaagacaaagatcacagtggtagtttaagaaatgaaagcttagatttgattgtctgttttgttttaagggatgttgttttgagtttattttcttagtattaggataggtcattcaaagagattggaacaaccatggaagaacattcagattattataggactgtgtttcagactgggagagcagagggccgttagcctcttcctgaccccaccctgaactcccctgaactcccacccttgtcccgagtatgcctgtccctgacaagagactttggtcagggaccaaagtgagctttgttagtgagcattcacagagggtaggagctgagtccacaaagttcacatcatgccaaggaatggatttcctcccagggccactagcattacttgtgggttatcaagtgttactgctcacacattccagagcttctggaaaagccgtaaggaaatggctttcagaaagccatttctgtcctagaggagagaggtcctggatttcactgaaccagaacttgatgggtggttttggtattctgtgacctaggtagtggggagctccttcctttggatgtttcctttatgcccacagtcgaaccatatcctagttgtacagccaagaaggatcttttctgtttaatctatctggaggaatagaaggtaattgtatcctccttattttcattctgccacccctaccttcatcatttcttcctttctgctaagcactttttatcgtctttctttgtttcgttttgggagttttgtttttttgttttctttcctcaggaaagctgaattatttcttacagagtcatttagttcttactgaaactggggaagaaaaagattatgcaacagcaggcataaggaaaaacagagaacgttcttcccttcgggcccacagagcccattggaggaattcagctacaatcctgcctgggaagtagtttccaggaccttcgcaattccacatagcatctttaacatgtttgagagtacgtaaggaggcagcatagtgcggcggaaagaacactcaagtgagtgttgagggggctggattctaatattaatattagccaacatttattgaacaggctaggtgctagattctgtttaaagcactttatgtggattatctcactattcttattatcctattttacagatgtggaagctgaagcatagagggtttaaatataatttacccaaggtcatcaattggggagtagaagtaggattcaattcctgctccagagcctgcatgttcagctctcttttaatactgcatgtggtccttgataggctactgaccctggaaaagtcatttcaacttttagggctcattggtgaaccataaccaaagggagctcattgtggctaacctctgatggagtttccacttttaataatttatatgatgaaacgcagctatattgtttagttcttgtcattatgtgaaagcatagtatttaaactttgatctcattgattcagcaactgattattttatggccactgtgcacaaagcaatgggctgggtaccacagaggattcagaaaaatgcttaaaaagttaaaacctatctcttccattagctttagatggtttcatattgtagttgctttgagatttttttagactaagtttttcagataattaaacaggaatcaaattcaaaaactattcatattccagaagaggaatcctgaaacaagtattgggccttagactagtcaagtttctgacattttcttttaaaatataacttgtcactaggatagtttatatccattaactcctgagtgaaggagcttctggtgaaattgttttttatggtgcttacaagctcaaggggttctttaaaaatggaatgtgactgctttgggagtcactaatactgaagctggatcattataacctgaaatatccattagtaacttagaaagacaaactcaaagaaaaataatttactgtgtaatagctggattttttgaaatcagatttttttttttttttttttggcaagctagattcaatatctagcttgctgtggaattaggttatggtgtggaaacctcttggctgggacaggaaaaaaaattgatcttaaactaaaaaaactaacttaagatattccatttctagtaatacctttgagattggaagaattgcattctgatgggcccagacgttagattaatgtccatctttctcaacaggttgtaaacttttaaactttctgttttgcattcagaccacaagtgcctgacacttaatagatgttctataaatatttgctgatggactctttattgctcactccctaaaatccagccatttctcccttgccagcattcaataattgaacctgctttgaaacatctgatcagccacttcaagacggcaagttattttagctcctgtctaaataagttagtgggctccagtccttaaaccactattttctttattaattcctcaagtacagacttttgtatgtaaccagtctttttaaacctgtgtataatgactcattaatgagttgtaaaataaatgtagtgagttatgaccaatataaaaaaatagaaaaggccaggcacagtcgctcgagaatataatcccagctactctaagaggctgaggtggagggatctttaggccaggagtttgagaccagcctggggaaacatcacgagactccatatctgaaaacaatttttttaaaaattagccaagcatgcctgttaccagctacttgggaagctgaggcaggaggattgtttgaagccaggagtttgagaccagcctgagcaaactcagtgagatcccatctctacaaaaattaccaaaattaaccagcatgttggtacacatctgtcgtcccagctacatgggaagctgagggaggaggatcacgtgacagttgagcccaagagttcaaggctgcagtgagctatgatcaggccactgcattctagcctgggcaatagagcaagaccttgtatctaaaaagaaagaaagaaaagaaaaaagataaaagaataggaaatatcatagtggacagcacataagtagaggtgaagccagctggacttcctcggtggagtggggtcttggagaacttttctgtctagctagaggattgtaaatgcaccaatcagcactctgtaaaaacgcaccaatcagcgctctgtgtctagctaaaggattgtaaaggcaccaatcagcactctgtaaaaatgcaccaatcagcgctctgtgtctagctaaaggattataaatgcaccaatcagcactcttaagagctgtaacactcaccgcgaaggtccacagcttcattcttgaagtcagtgagaccaagaacccaccagaaggaaccaactccggacacataagtacttttattatagacacatattatgctgtattgcaataaaaaatgtattttttgaacatcctagtctacctatcttcagaaggcaaaagcacctctggtgtccctgttgtggtatctcctagcctacctctctataaaagttttgcaattaagtatatttgtgttttatacatccttgggcttctcatagtttaaggtcctaactggagttcagtctttctcagagccgtctcatggtatcctcactgatgaatgaatgctgaatagaaagagccctgcttgcatatatgcaggtagtatggtggaggggaaatctagaagtcatttctgagctctgacctgctggatcatcaccccctgaacccccagagcctcggcatacagcctcacactgtaccacctattttggtggcccaagttagctgagagagaggaccagacacagtgcccaccatcacctagcactggccctgctaccaaacagtcattccttttagccctctcctccccaccaaaagcatttcaggcaaagtgccagctcctgaaatgtggcctctttgaagtggttagtgaatgcccctgaaaccaccaccttatgtatggtggtgcttctgctgccagagcttaatacagggtcatgttcctttcctctgaaatctgtaacataaattcagttttaaactggattttttttttaacagttggtctctgaacaatctttagggtggggaggggatagtagtggttgttggggagatatgtgcccttgaaaactggattcttttttggaaaactgctgacacaggctaaatggcagagaactaaatggccctactgttcctacctgctgacaggctcagccttgggatggggctgaaatgagctctcgccacatggcagagacatgccttcctctttttattcttctttcttacaaatagggggtacttttgtgcctgtcaaaaaatacagctttgaaatgtagataaccaattaacaacagtcccacccccaacttggaaagcacatgagtgctgatctaaataactagagaatcggtaacaagtaacctccctattgagaacaggtctgaaacctctttcataattggtgttctttgggaaacgctaatagacaaacccatccaagctcaggaaatgtactgatttaaagaggtctaaggaagagtgaccagcccagtggccaggcatcccggatgcctaggatccttatgtttccgtacatatctgctgttacatcctttctgtgagcaaggaggctttggaacattacagtcttgtcttggggagatgagatgacacagtgcatttcagttctgtttccaatgctgttatctgttggaaaaaggaagctttcctacccattttgtcagcatacaactggtaggagctgttgcaatctcattgtcttctgatcagcccctcggcagcagtcagagtggaggccagtgaagcactctgaccaaatggttgtggtgagtttcaaaataagagatcccagcctgagcacaccatcacacttcccatccgatagaaccagcattgttaactgtaccacatctctattctaaatttaggcatctttttttttttccaggcaaagattactatgcaaacatttaagagaaaaactttgtccaaagtaattttttcccccaacttctatttggtttcctgcaatgttgagatgactcattctcttccaagaaattttaaagaaaagagatgcaggctgtatgttagtacacaaagactgctctgtaaattctttttcttccctgtctagaaaccccttgcctttttatagagaacggaaaagctctacagtcttcattgtcatgtactcggcctcatcaggttttgttgttcccaggaataaatgtcccccttgtctttgggtggggcccccttgtggcttaccagctctgtcaaccccactgcagtggccagcacggaagcccttcctggggccacgctttcccccaaaggcacacagttaaggtttctgaaacagagaacgaatggccttttatcatctgtgaaaggagagacactggcaatttcctgcctctggcctagtgtcagaatttctcctgattgctagaggctgtattgcacattttaagtgggctcgctacacatgtagtcccagcccaaccctcagccagagggagcagtaagtcagatcacttcagcagcctgttcaaataaacagggataatagttgagtggtcctcccaactaatcagtacatgaaaggaaacatctgcctgggcttaattgctgttgtttttggttacacttttccctccccttcttcccccatcccccactctggggctaggttatttaagtcatgggtaagcaacagggtagaggaataggagctttctcctttaacctctgccattcaaacataaggaggagttaagaaacgataggctggcagggggagatggcccggaggcaggagggcagggcggtgggaagtgatactcatggtcacttcctgaccctgttgctgactctggggctcagagtgagtcatgttgcctcacttcacctccttgggcctctgttgcttcagtggagctcagctttcctctcaatggaaaggacaggctggtatgtgagatcacagatgaaaggcattccctcttgtggcttcttccagcagttgaggtcattggatgagagaccctggaatgataaatttaagactggcaagatcccctgaacccgtccattttgtagagcatctgggtccccgaggagaacttgctcattatcttctagccaaccagccatacactaaagggagggatgtttgaagctaatatggactctagaagccaggcagaagatcatgtagaatcatagaatggcagaggttggaaaagactttagaaatgttttagctgaagcttttcattttatagaagggaaaacagagggccagagaggttaaccaggttgtccagagttacctctttggtaatgcaggagccaggaatagaaagagaatcttgtgattgctaatttagggctccttccacccctttccccactatcagatgtaaaaattcatgcttactcatgacagaggccacacataggttatattccataatgaataccttaatagaaaaatgggcagagaacaccttaataagaaaatggcagattataaaagaaaaatgaaaatgactgataaacatttttaaaaatgctcaggctcattagaatcaaaggattgcaaattacaataggataccacatcaaattgtcaagacaaaaaaatgtgaaataaacattcatatatgctattggtggtattttaaattggtaccgtttttctcaaaggcattttagtggtataaatggtagtctttgacccagcaatgttatttctaggagaaaataatgaaaggtgtgtgcattagatcatatacaaagtaatgtgatatggcattttttatcacaaaaatttagaagtgaagtaaatgtccaagaatgggagctacatcaatagaacgtattataatgctatagaacaataatacatgtggaaatgtttacaacatatgtttaagtgaataagttacaaaacaggatttataatgcaatcccaattttgtaaaactagaaaagattagaaaaatacataacaacacttagagtggtgatttcttagtggtaggaatttaagagttacttttgttttcttttttgaggttttctagtttccttattataataaacatacattacttttgtaatcagaaaaaaaagtattttttaagtagagatgtatgtaccttgaaaaaaagcaagatcttaaatgattgtgtatctgacatgaaagtccttcctttttttgcctgggagctagcagctatggtgggagggatgggaaacagtattataacttctgttagggtggcattttgatacccgaatttctggtaggaaagatctagaaggagctggcaaaagataaaacaagggctttccctctcaatgacccatgctgccaatcagttttagctctcttaggtttggcatacaacacttagtatagaaggtgtgacaatttccttcctgcttcctcctttctttccttttcttttcttttcttttttttgagacagagtctcactcttgtcacccaggctggagtgcaatggtgcaatctcggctcactgcaacctccaccttctgggttcaagcaattctcctgcctcagcctcctgagtagctgggactacaggcgtgtgccatcaggcccggctaatttttgtatttttagtagagatggggtttcactatgttggccatgctggtctcgaattcctgacctcagctgatccacccaccttggcctctcaaagtgccgggattacaggtgtgagccaccgtgcccagccctcattctttatttctactgctctatgtagttagatgtcagccctgggtggcagcagcaaagaacccaggagccatcactgctcaagattaactagttggagaccccttaacatatattttcagcatctagtaacagctaatctcacaggcagtcaatattgagataccgctgccttgtgagttttgggtagaaataaagcaagtaagaaatatagttccatcctgcttggagttttctatttagttagggactttgaagtccctaaatgtttatatactttttcctatttcatcccattacacatcttactttcctttgaaatcttctggaatgcttgactgcaagtatctgagaaaccgtgttccacctaacaacagttgctaggtaggatgtggctttcaggcctgctctttggggaccaatagaaaaaccaaaggctaccaccctttttccctctacgcaattgcctttgctaggctatagagagggcacatttcattttattaaaactctttgagtaatctgaccataattgggtctgattggagtggttatctgatttgctgggttaaataatgggccttaattgagtctgggttatttgtagagccagtgtggcttttgcctttgttgctccctcctctctcttctgtttcccaattaaccttcattcctctttccttgcagagtaaagaagtcggccagcagctccaagatgatttgatgaaggtcctgaacgagctctactcggtaaatcagatgggttgcttggctctttaacaagcagagggaagcagcatttggcagcttgcagccatagtacatcagcaacagaactgaactgaggttgaggacaagtgcatggtccccactgggggtgaccccacccatctcttttttcacactcgtcttttcaaaacggaatgagtcaaaaaatacttcctcaaaataagttttctcctcagctatgcaagctcaccctggctttatttggggcataattactagagaccagccaaagtctaggtcattggcacaatggaccctgttagcagcaaaccagggaccctgaactaatggcaaggaacgtagcctgcattgcactattaatatgtgcctgtcggaaagcctttattgttctaggtttttcatcagatcttggattgatgtatggctttgagactagaacaaatgctctagagggcagcacagagtcctaaatgtccccagtaagagggaccagtttgagcagagagagctttgcctggcttcctggagttttataaagccaaacctcagtgacgaggcaggctgcgggcttggagaagagaacacaatctgttctgagatgactggcgcttcaggcacatgatgcctgtggctggtgcgtgttaattcatgcgcagagaggtggtggtggtggttgttccccagccatgtttttctaattataatgaaaacaaacacacactcacacacatacacaccaaggaaattcctgttgttatacagggaatacttaagttatacagctaatgcctttcaggggccccttctccagcttggatgtgccagcctactatgtcattctccagggtttctccatcctgtttgaaggtgatactgatttctgatgtttacttgcttatttgctgcattttttcttttcttttcttcctttgtttttttttttaattcacagaacaggcagtggtgacatgcatgacaggcatttgggatcagatgttgctgatccagaagcctaggtgtggccattttgtcatggcaactgttaagcaagtaaatagggtagagtagtcatctgacttatctccagcgatgttcagtttgttttgaatttctactctgtgacacttctgctctgaagccaagcatagatagatggtacctttcgttcaactcccaagttttcatttctctcaaatgaagttaagaggttttaaaaatagaaacacatcgatgtgagccattttcagactggatgggtttcctgaaccttgtctttttaatgctttacttctgctcttttagatcaatttctaagcgccaagaagagctattactcctttctcctagcagagaattccctaagatagaaaatgacacatgtagtcattgtataaattcttttattttcctgtaagcatcttgaccctctactatttgcagctgtttctggggaggagtagtttggataaccaacaaaccttgccacttcttcagtgggactcaaggcagcagaagaagactactgtctaaggatctgttagcttttacccagggtcctatgtctcttcatatgctgtgctttaaaaaaaaaaaaataagtgaaagggcgtaagctgtgtttgagtgaggaagaaaaccttggaacttatttctctggtctgcagagggccgagctgctacctctgactgcagacttaagacagcccaatattcgccaactactttactggccattgtgaggccatggtcaacatagagcataacatcttcccattgatgttcaaactgagaattgcctgagtgtggtatcccctgccataaggtgagctggaatacaccttcataatctgttaaaggccaaaattaaaatgtgatgttttcctctagtaggcaatggaaagagggaaaaaaaagagtagaggcactaggaagtttcagagaagtcaaaacattctggtccaaatggagttttaagcagagggagttttaccccgagaggacatttggcaatgcctgaagacatttttgattgtcacaactggaggagtagaaggtgctactgacatctaatgatctagaggccaggggtgctgctaaaatcctacagtgcacagggcagctcccacaacaaagaattatctgacccacaatgtcaatacagagacattgacaatcttctgacccacaagattgagaaatgctggtctagtgactagagtctcctgaattaagcagcctagattctaccctgtcttgactactagctgtatgagcttgagggataccccaaacctctatgaccttggtgtctgcatacactccatgcactggtatttctatatcctagggggtggagtagttgggtgagttatacttcctgaaatattaggctatagctaaggatcaaataggtttccagagtctgtaggccattagaaagttcagtgagccaggctcatgcctgtaatcccagcactttgggaggctgaggcaggcagatcacgaggtcaggagatcgagaccatcctggctaacacggtgaaaccctgtctctactaaaaatacaaaaaaaattagctgggcatggtggcgggtgcctgtagtcccagctactggggaggctgaggcaggagaatggcgtgaacctgggaggcagagcttgcagtgagccgagatcgtgccactgcactccagcctgggcaacagagcgagactgtctcaaaaaaaaaaaaaagaaaaaggaaaaaaagagaaagttcagagaatagccgggcacagtggctcatgcccgtaatcccagcactttgggaggctgaggtgggcggatcatgaggtcaggagatcgagaccatcctggctaacacggtgaaaacccatctctactaaaaatgtattaaaaactagccaggcatggtggtgggcgcctatagtcccagctactcaggaggctgaggcaggagaatggcatgaacccaggaggcagagctagcagtgagccaagatcgtgccactgcactccagcctgggggacagagcaagactctgtctcaaaaaaaaaaaaaaaaaaaaaaaatagcagttcagagaatagaattatttcttctggagattaagataggtttaggactggtctgaataaggcaccatgggattacggtgactaactgtccctctttgcctagtactgaagagtttcctgggacatgaaattgtcagtgatgaaactggaaaagttctaggttaaaaagggttaattggtcaccttgcatgggagagtggttttatcaggtgggaagctgggactgttacatgctagctttgggaagctgcttgctgtatgcacacctttgaggagtcaagaagagaacaagggagagtttcttagaaggagctttcccattatttgcttgtcaggaaggcagggaagggcctctcatttcaatgacgttgtaggcaatagaagttatttggggtcactggaaaaaggaaaccaaggatataagaaacccacccagttttttcatgtccttcacatctgctcctaatgcccatgaatacctttttttaggggactagttatccaagggttggtaattttagtacctttgaaccttgatgatccaaggagcaggacccaggtgttcccaaataaagatgcctttgggcaccgggcccagaatgccgccatgagtggccagctgcccctctgcaccttcctcttttctgcctgaagggcctttgatttccctgacttggcattctgtgctggggcctgcttcccacagctgctattcagagagcaatcctagcgagcattcttctccacgtgttttccccccataatgagctggcttgtatgtaagccatggcataagtggttttcattttctgactgatgcaccgggaatgcctttgaagtcagaacacactgcttcccaaagaactctgggattctttgcctcagttgtactcagaggtcgtgtctggaaaaacccagcaaacccccacaggaaggagtgtacatggaggcactgaagccagtgtggattggctgagtatgaagagtcaaggaagctctagaattgagaaaaaagaggctttgggacactttggggctgttgttattccagaggccttatgcttctgtactccccctaaatttacatccccttggcttggagcagcggctgtgtgctggcagagctacttcagactggtatttagcacctgttcccttgaaacaatggcacttaatagtctctcaactctgcttgcctatttgactctggcactaggcactagggagacaagaacaaataagagatgtttctgacctcaaggcgtttagttttaatagggagagacagaaaagtaaagcatcaagtgaaaaatgaagtgacaagaactcatttacatgtctgcacagaggacagggatgaagtcaggctccttgaagagatacttgaattgaatctttattgccaagaactcttttcttgttctctacatgttcccttttttgttgcatccaacttttgtttcatgatgcagtatcgttttatttctcatttatctctccagggctattatggatatattgttttcaaacttttcttcttgttgtataatatttcttctaaattgctagttttggtcttggtctttcatattagacatttcctttaaatgcctggtcattcttagctgcctattcacattttaaagtgaggcactaaaagattctatgtcagctgtggccttcacagtagggtgttctaactgggctgtgtccttgtggaagccccaactttagtatttctaggtctcttatcttggatggtcagattgccgagagatcacacttttgatctcccactcatgtctgggagctgagttgtgaagaggcctagaccatctcaaaatttaacatagacttcagctaatcctcctgttgaagttcagtatacccctatcctcagctgaaccttgtatcccctagtccatggaccctctctaacagaataaacctctcatctagtcttccactacaatgggagggggatcttggggcctcactgttctcagacttcctttttttttttttttttttttttttttgagatggagtcttgctctgttgcccaggctggagtgcagtggcgtgatctcggctcactgcaagctccacctcccaggttcatgccattctcctgcctcagcctcccgagtagctgggactacaggcacccgccaccacgcccagttaatttatttttgtatttttagtagaggcggggtttcatcgtgttagccaggatggtctcaatctcctgacctcgtgatccgcccgcctgggcctcccaaagtgctgggattacaggcatgagccgccatgcccggcctgttctcagactttcaatagcttattttgtgtttagctctaccttcatcccactgctacttatttctcttcgggcttctgtgatataaatctggctgcttcctggctcactctagttttggtttaggactcaagtagatgagttactgtttgcctacctgcttttcggcttcagcttccattctttttgtttttctcaatttatacctaaatgataatcattttagaaccttttttttcctattattttagtgtggctgtcagagggagcagagctaaatatgtgacttcagtgtttagtttttcaaagtaaagtggaatgttctttgcagaactgagaatttagacttttcagtttttccccatagtttgcatttgcctatctatatatagatagaagtatgtatatgtatatctttatgtatacatatctatatatacatatatgtgtagctatatgtctaagacatagatatatagatatacatacatttacatatgtatatgtacatagatatatatatctaagtcctatcttggctttctctaagtcctatcttgactataaatatatatttataaatatatatttaacatgtatatctgtatctatatacatttctaagtcctgtcttgactttcctattttttcaattgttttggcatcacttatttaagcttcagcttctaggtacctcagttttctcttgagctggaaggcactaataaagcttctccagtatttacccagaagagagattcagtgtcattcagtcatttgggcaaccactttgtaaaactaccattgtgtatatgacatatttctccactgtgagaagaaaacacaaaagaagtagagcttagcgtgaagaatgtatagtttcttaggcaaagtagcgttttactctcttttaacaagaaagttctttaagttttttaggggaaagtaacattgtaaattgttgatttttgttacttcatttgttgacttggtagcgctattctttgaccccttttttatctcatgtttattcataacgttttctctttatcatgcaccttcatgaaataggaaatcactttaaaaaagaaaaaaagcactcacttttgtaacttctcactaagcttttgaatcccatggtcagattcaggtgaaaaaagagaaaaaaaagaggagcctcctatctacacttcttcagctgagataacagatgcctcttttccacttcttagttaacctggaaagctgggggtctgtttgaattacttagaaaggcttttaaacgccattagttgttaagtattttttcttctgtatagaaaatatgaagagtattatcctggtaaaatttacgggaagtagtgttaggttcagaatgaggtgaaactgatttaaaacattctgcattcaaaatgagacataatttagactctaatgtactttgattttgtcagtgtcccagtattctttattctttcatctgcctctagctgatcgtaggggctagattagtatacccacaaagtctttctaagctagattttctcagcgtcagcaccattgacatttgggccagataattagttgttgtgggggctgtcctgtgcatgggatgttcagcagcatccctgacctctaactactagatgccagtagcaatccccaagttgtgacaatcaaaaatatttccagacactgccacatttcccctgggggccaaaatagccccaggttgagacacttctctaactcaggttcatacatggaaccagtttctcttttcaggaatatcttgaccatatttaacctttcctcccaaccagttcagctccagtcctatccagaggagagtcggtgttgcttaatggctaagaatgtggtctttggagtctgacagacctgggtttgaatcctgattccaccatttactcattgtatgaccttgggtatgatagttaatctctctgagccttatttccttatctttagaaatagaaataataacagtgtctttcacagagttattgtaagaattaaatgaggtaatgtacgtaaagcccatggtacacaatgtttattaagtggtagatattaataataatattgtacctttgcactcctgtgttacacacacacatgcacacacacacacacacacacacacatgcacacacacacccaacttctactctctaattctccatctcaaagaaatcttatggcatcacactttcagcactcgtgaactccctgtgtggaaacagaaagttcccacagagtagagcaggcactaggtggctggaagtagtatgtttagtaggattggaaacaagcttgagttctaggcttcctggcctccctgttaagagaaaggattggactcctagatggttgctttgatggaaaatcatccttcaccttttatactacttccctcctgtggcaattccagttatacttgatatggattttattccttcccagactcttacctgaattgttttgaaggcttacagtcttcatagggttgttgtctagattgtggaattgtcctaaggatgaaatgagaaaatgtgttgtgtggtacttggcataaagccaggaatatactaagtgctcagtaaatgataactggcattgcagttgctgtgagagggtgtttgatctggataaagcagaacagacagatccccagaatgccaggccggtaaaaggagcttttggaagcttttcctcttccctattttatatctgaaaggtaacagaaagcataggctactccataggctgcactgccctcttcggggttcctgaccagcccagaaaggctttgcccttggggcctgagagtggtggtgttgtttcccatctactcagtattatgaggtgactaagtgatagaaatcacctggccaatattaaagagaaatgattacaaatgataatgaatagaaataaataatacatgatggatagacattaagttatttcaataagaggaaatgttggctcagttcacatattgctttcctgtgctttggagtggtctttaatctgtgtttgctgaaccaaacacttctggatttttcccttaggggtgtgaggatattgcttcatgggggagagctccagctgagtctgttagtctgtaaagcagagaaatgacccccttggcttgacctctgggggtgggggtgggcgatgtcttgcaggtgatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaaggtatgtaggctcccacagctgtagatgctgggaagcaacattcggtaaggcatggctgataggaatttcccagtagtcactgggaagagcagacgaggaagctctgggttcttttagtgcctaatgactgaaaatgaggccttgctctgtgccctggcaggaatactaggtattggaagaactgggcacgtgggatccaagtttctagcctctagcagaaaaccaagaaacagcagtcacctttcccaatccattttccaaatagagctcaatatcctattgctttggaggggttgggggtgactgtaaacccaggatttggtttcaggtatcaggtgttcaggggcaagagtagtggtacctccttcagagtggcattgcaagaatgaagaatgatatttgaagatagaatcaaagtggggcacgcatcttaagtagggagcctcattaacctttcctgaattgatctacattgtgcccttgaatctcattaaacagaattagaacccaatttaaggcagatgcgcatagggagtagcaacacaattgtagttcttgaatacactgtacttttatcttttagagaacaagccccccttaaaaaaaaaaaggtaaaagtgaacttctgtttccttttcagcgtcaagccaagtacacggagaataagctgaaggccatcaaagcccggaatgagtacttgctggctttggaggcaaccaatgcatctgtcttcaagtactacatccatgacctatctgaccttattgatgtaagtgcttaaagccaagggcctgagggcacctcttttctggtttcagaatactcgtcagacattccccgatactattgttcaggaatctggtgcattttgagaacaattaggaagatagcagccatgatccatcagggtgcttgccaagcaccaagtgaaacacttcacacttattcaatcctaactggaattctgggaggaaggcattattatctatatttttacagattaacagagagtttagatgacttagtcagagtcagttaacaaatgacagaggcaaaatttgcacctaggcctgatgactcaacccaggctcataaccactacactcgtctatctgccaggaaatactttcttccttttttttttttttttttttttttttttgagatagagtcttgctctgtcccccaggctggagtgcagtggtgcaatcttggctcactgcaacctccatctcccaggttcaagcaattgtcctacctcagcctccccagtaactgggactacaggcatgcatcaccatgcccagctaatttttgtatttttagtagagatggggtttcaccatgttagtgaagctgatctggaactcctcacctcaggtgacctgacctcaggtgatccacctgcctcgacttcccaaagtgctaggattacaggtgtgggccctgcacccgacctaggaaatactttattacatcagcttctcttgcacagaagtgagtggcaagaacttaactaaagagttacaatgccatcccttatatttgtatagcatttaaggtttctcagtgttaactcatttgactctcacatcaccattatgggtaagcattgctgtctccagttgctagataaggaagctcaaggtccagaggactacgagactcacttgtccaaggttatgctgcaaattagggtcctgtcaggaaggtatccagctccccctgacatctggcccattttttaaaatatgtgatgcaaaggggattgaggaaagcggctaataggcacatgtgttttgcaaggggcaagcgcagggataagctttttgttttttgcctgtgagttattcttggccttgtttttcctgctgcttccccttacagttgggtcttacaagccctctcacctacagactccaatctggcccaggtcctgagccacacctaagtgaagctatgtaattacaccctttctcacctctccttccagtcatcaaagtgaggcatctggagccagccaatttagcatcccagtctctggggcttcaagtgtatctcatctcggaggcctgccatttgtttcagggtcttgttggcagcagttgggctttgcaaaactctggcccgaccactcttgctttcctgccttggtttctccacaagcaaacctgccacacctcacaacatcatatgggatttgggtccgagtcttgctgttatatcaccacctgggtcatctaggcttgtcactgaattgttctgaaacccagctttgtttctcacccactcccaagctcctctagctaactgaagaactggactaattccctggtattaaaatctggcctcacgtaagagttgcttggggaacttctctaaaatacagattcctgtctccctttagccgaggatttttgattcagtagatttcagccacttaatgccctaggtgtcattgtctcactgggttagtagagccttgctccctgttctggtacctctttgttctctctgcttattgatgacaatctgaacactgtccttcaatggaggtcaaagccctaaacaagatcctttctcctcctcaggggaagagctcctcattgttgggagagaggcctgttctcagcataaggaagagaatccattctttcttatgcacaatttctgctatttatctcgcatttggtaaaaattcagactgtgctgtctgccacaccactgctattggttagccctcttctctttttttgtactcaaggcaacttccctacctttttcaccgaaatactgatctcaggggaagggaggggttactgctgtatcagccacaacctttgcaatccatagattctccatcaggtataaccaagtgttttaaaatcagtccaagaagtgaggtattttgtaccttattttcatcatttaaaaaaaaaaaaacgtctgctaagagcctaatttcacaggatgtggtgtgacatgccattgaaaaagaggctgccttagtacttggcagggtgtgggtctagatcactgggatcaaaaggctacataggtagtaataaagtttctcatgtttctttttttttttttttgagaaggagtctctctctgtcgcccaggctggagtacggtggtgcgatctcggctcactgcaagctccgcctcccaggttcacgccattctcctgcctcagcctcccgagtagctgggactacaggcacctgccaccacgcccagctaattttttgtatttttttagtagagacaggttttcactgtgttagccaggatggtctcgatctcctgacctcgtgatccgcctgcctcagcctcgtttctttgctgctgttttggttgtgtcttgttttagtttgttggttggttgggtttttgttgtttttcctgggatatggacacattcattattttttttaaagttgtattattctgctctataaatgttcagtaaatatttatttagggagaagccacgtgctcagtattggggtaaaaatggattatagtagttctcaccctagaggtagtcataggctgtaagacaacatttttcaaaccattggtcagatcccttaagaaagccaggaaatcacttttattggtttaacctgtgttttcagatgactagatgagactagaataagaaagaaaatattagagtacatcacattggtaagattatgtgaaacttttatgttagatatgtatgtacacacttgtacatcctatgggggagtgtgtgacaatagaagatgtgtttcttattgtgagttgggagtcaaaaaagtgtttgtgagccattgtactatgaacagaggaagatctcagtctcatctgttaagttctgtgagagcaggaaccaagagttttctttaccttagtagcctccagtgcttaatatatagctgagcacatagtgtgtttactgaaggaagaaaggaatagaaagaggaggaagatgatcatctaagctaagatcggtttttctttttgtacctttcaatatggttttgaagtataatttacatacagtaactaaacttaagtgttacagtttcaagagttttgacaaatttgtacatctttgtaacctatgtcaagatatagaataaatattttgataagagatatctttccattgcctcagaaagtttctcttgtctcttcccagccaatcccccaccccaaggcaaccactgttatgatttctttcaccataaattagttttgcccattgtagaacttcacaaagatgggattatccttttttgtgtctggcatcttttgtcagcatgatgtttttgaatttcatccatgttgtttgcatgtatcggtagtgtctttctttttcttgctgacctatgagataaaaagggccaaaaggatgcagttagagcaggactaagtgaggagcctgggatattggcatcctgatcttaacattattcattacttgctttaagacatgggatgaatcctgttgcagtccattgccatctgtgtcatgtacagccttctgcctccttcttagtggttctgaagccaaatgtgtgcataaggcattgaggataagtgaaaagaagttatttttgttgatgccattacattgaccaaggactagcctccgacttctttttatagtatagtgcaagatttaaacttcagactgtaggaatccacgtgaggcatctgccacactggggaaaccttgacttcaggccaaaaagacgttctgagctcatttgatggcatctaagaacgtaggctcactggaatgtaattttcctcccccatactcttctggctctctcaacccaggagcagatggatgaatgaagaacagggcattgtcctcatgcatagctggagtgttgtaagtgccgtgtacatgtatggaaggtctgtgacaccatgtgcacccaagtcggacatgagggaacttggctgtttcagtaagaaatgtcattaagggcag

SEQ ID NO: 78 - DNA, 161552 bp, Homo sapiens
gttggttcgctctttttttcctcttcattaagtgaaagcaaactgctgttttcaacatacgtattttctgagagattatacattgctattaccttttggctcagactcgatttttctatgctttcaactttttttttttttctagctaggatttgaacctatatcctttcaacttcttttagaaccattttaatgcctagagcattggactcagaagtctagcttctggccgggcacggtggctcatgcctgtaatcgcagcactttgggaggctgaggcaggtggatcacctgaggtcaggagttcgagaccagcctggtcaacatgatgaaaccccatctctactaaaaatacaaaaattagctgggtgtggtggtgggtgcctgtaatcccagctacttgggaggctgaggcaggagaattgctggaacccgagagacggaggttacagtgagctgagatcgtgctattgcactccagctcgggtgacaacagtgagactccatctcaaaaaaaagaaaaaaaaaagtctagcttctgattctacttcaattattaattggtaggaaaagtaaaaatagtattttctctaaggatactttaaggaaattaacgtttgaggcttattgaaaaatttggcaagaggtctctttttattcttttttctttttaaaaaaaagaaaatagagacaaggccttaccatgttgcccacgctggtctgaaactcctgggctcacgtgatccacccacctcggcttcccagagtgctgggattacaggcatgagccaccatactccgcagcaagcggccttttctaaatagtaaatgtattgttttcttttagtcatattggaagaattttaagtgttaatgtggcagcttccctctgttcatataatgatgggtttacaaattattttggctgatctcagaattatggtattctgaatttattaatcttcgaacctgtaggtagtctcttttcagaaccattgaattaagctattaagtgagataccagaaggtctcccaaacatatctaattttatagacagtttaaagcagacaagtttgtaatgttaggacaatctttattttgtatcttttcgaaataggatgtgagctgcaatgaaattcaaactataccttcccaaattggtaacctggaggccttgagagaccttaatgtaagaagaaatcacctagtacatttgcctgaaggtaagaaactatgaaataagaaaccatgaaataattgttttattattttaaagctctctcagaccaatcaagacaaaaatgtataagggttacatctaggctgggcgctgtggctcctgcctgtaatgccaacactttgggaggccgatgagggaggattgcttgaacccaggaattcgagaccagcctgggcaatatagggagtctgtctctacagaaaattaacaaattagcccagggggctggcgcactcttgtagtcccagctactcaggaagctgaggtgggaggagtccctgagcccaggaggccaaggctgcagtgagctgtggtggggtcactgcactctagcctgagcaccagaaagagaccttttttaaaaaaacggggtggggagagagagagagagtgtgtgtgtgtctgtgtgtgtttgtgtgtgtgtgagagagtatgtgtgtgttacctccagtgtttgaaatctaatggtttatttaatagtgttatctgttccattgtggattttaaaagcctcttcaatgaaaaggtttgataactcttgacctttgattttatttttagatcttgtcaaccgatgtaattaataactcagggtagggtccctggaaatttcagtaagcatgactgtttgggggaaatgtaacatgtttggataaggggatagtgtagtataatgaaaaacatttctgcagttagcactcacttaaaaatggactttgacctgaacttaaccggtcactggagatgttcaaacagaggctaatgaaccatgtggaggtgatgtgtagagtgaatgataaatggggtgagagactgcgctaagagacgggttatttacttaggctgactacaagctctgatatatgtatttgataaaaatgattaaacattaatgaagtctagtttatcaatctttcacaaattaatgaaacagaatgctagaaaggaagatgaaaatgagagctattattttatgagatccagaatatatatttcttcctatatgtttctgctcatcacccagcagtaagagtcatcagctcatggcaagtcttgtctcaactgtgctctcatttactttcccctgcactattctctagattaatttgaatcaaatacagaaatttattggtaaacattccagaaaaacaaggaatcttctcaaggtattttcatgacagtgcttttctgggttctttgacaaaatatgacttacagtgtacaatcaatattttgtttgttttgagacagggtctcactcccattactcaggctagagtgcagtggcacgaacatggctcactgcagcctcgacctctcaggtttaggtgatcctctcacctcagcctcccaggtagcttagactacaggcacttgccaccatgtcacctactttttgtatttttagtagagacggggttttgccctgttgcccaggctggtctcaaactcctggggtcaagagatccacttgcctcagcctgtcagagtgctgggattataggcgtgagccactgcacctggccacaatacatgttgaattaactaatgatgttttcgctttccctgtggaattcaaatatttataccaatttgatacagcataatatttagttctaacatactagtggagctttgacattttggattccaagtaaatgtgtaagaacgtgaccttttcagtccacttttatatacttactgcaaccaaaaccttgcgtgtctttcctctcacttggcttgtccaggaaccttcacactttttatcctcagggccttccttattttctcctggttctgtttgctaccaactcaggaatgtaaatgaaggttagcaaaaccaaaatcatgacctctaggaccttataaccccaaatttctccctagggttacctctgtactcaggactcgcctactgtggttggtcttcaaagacttactcctataataatatttagtgtgaaatcaattaatgagaatattagggttttaatcaaaatgaaaattgagcatttcagatgacaatggaagcttaatagttttatcaactaatttatttctgtatcttattttgattgtagactgctgacaaaatggtttatcacacaaatagtttcaatttttttaacagtttattttataatctcagcacatatagttgaactgagttagcaagtgaagctttattccaacagctacattcgttcgtgtggaagtttgtgttacttaattggtaatttctaacattgcaatttggtacatgtcatatatcttttgttatattgccattttgatttaaaattaatttttaccaaataatatgttacatcattcaaaaaatattaaaaaatattaagaatcttttttttttttttttcttgagacggagtctcactctgtcacgcaggctggagtgcagtggtgcgatctcagcttactgcaagcttcacctcctgggttcatgccattctcctgcctcagcctcccgagtagctggcattacaggcacacaccaccacacccagctaatttttgtatttttacttctttttttttttttgagacggagtctcacactgtcgccctggctggagtacagtggagtgatcttggctcactgcaacctctgcctcccaagtagctgggattacaggtgcccgccaccatgcccagttaatttttttttttttttttgtatttttagtagagacggggtttcattatgttggccaggctggtctcaaactcctgacctcatgatccgcctgcctcagcctcccaaagtgctaggattacaggcgtgagccaccgtgcccggccttttttgtatttttagtagagacggggtttcaccatgttgcccaggatggtcttgatctcctgacctcgtgatccgcctgcctcagcctcccaaaatgctgggattacagtcgtgagccaccgtgcccagccaagaatcttaaatagtgtcgttcccctgcctcaaacttccctgcacaccaatttcaatggccaaaagtatgtaccttcattaaactcctttgactctttttttttttgagatagggtctcactctgttgcccaggctggagtgcatggcgtgaccagagctcaccgtagcctcgaactctgtgggctgaagccatcctcccatctgagccttccaagtagctgggactgcagacatgcaccatcacacccagaaaattttgtattgttttgtagagacaagggtctcaccatgttcccctggctggtctcctggactcaagcaatccacccacctcagcctcccaaagtgctgagattacaggcatgagccacagtgcccagactgctgacatatttctaactgatatgtttttatagctattgctggtttgggcaactttgacacttatgtcagcttcctattgtgatgatagatgaggatttagtttccttacactgtcaccataccatgcctttactgctttcctcccatcttcccagtgtagttttagcacaacttctgattaaattgttactcagtgttcacattactgtaattatgtaaacattgttccctgccaattcaagtgatgtactctgattttatttcctttcttgtacatgtttttttctttttttttttgagacagagtcttgctctgtcgcccaggctggagtgcagtggcatgatcttggctcactgcagcctccgcctctcgggttcaagcaattctcctgcctcagcctcctgagtagctggaattacaggcgcccgccaccatgcccagctaatttttgtatttttagtagagatggggtttcaccatgttggtcaggctggtctcgaacccctgacctcgtgatccacccgccttggcctcccaaagtgctgggattacaggcgtgagccaccacgcccggctttttttttttttttcccctggaggtaatagtttcttatctttttatatgcttatttttatgtgtgtctatggctaattccaccctctttttccagcaggctttctggtcagaccagattctctatcccttttttccctgcacttccacctcactgagccctttttttctcttctgatgtggactggctgttctctagtattgctgcccagctttttttttttttgagacagtctcactctgtcacccaggctggagtacagtggcgcgatctcggctcacggtaacctctgcccccccgtcccgggttcaagtgattctctgcctcagcctcccaagtagctgggattataggagcccgccaccacgcctggctaacttttgtatttttagtagagatggggttttaccatcttggccaggctggtcttgaacttctgacctcgtgattcacccgccttggcctcccaaagtgctgggattacaggcgtgagccactgcacctggcctgctgcccagctttctttcttctgtgttaaatactctgagtcctagactctggatcttcctcagttactccctgttttgctggaggacatctcctagtagcttcccaagaacacgtcatgggagaacatatttttgagacttcactggaaaataaatgtctttattctatgttcccccttgattgtttgattataaatccaggttgaaaactattttctttcaagacttttaagtgttttttcactttccactttcagtgtttaaaattgatggttgaaaatctgatgccattcattcttaatcccagtattttgtgaccagcttttgctctctggaagattttaagatggtccctgtttatctgctgctctgaaattttatgttaatgtgccatagcatgagttgttttaatttaatgtgctggatacttggtgggcccctttccaaaccagagatccatatcttccgttttgggaaattgttttatatctttttttttttttttaaataattttctttcttctggtttctctgtcccctttttgaattattttgaattggatgttattagacctctttgttgatcctctttgatttttttttttttttttttttttttttttttttgagacagagtcttgctctgtctcccaggctggagtgcagtggctcaatctcggctcactgcaagctccgcctcccgggttcacgccattctcctgtctcagcctcccgagtagctgggactacaggcgcccgccaccacgcccagctaattttttgtatttttagtagagacggggtctcaccgtgttagccaggatggtctcgatctcctgacctcgtgatccgcctgcctcggcctcccaaagtactgggattacaggcttgagccaccgcgcccagctgatttttcttatattttttattattcatttctgtgtcattttgtgttaccttatggtaaaatagttccaaccattcttatgaatttttaattgctaccattatattttttcatttctacaaactcattctgtgatttttaaaaaatattccttttatgtttcagtgattaaagaccttctctttctgaaactaaagatagtctagcttttcaaaattttcttctgctttctataaaatacctgtttcttctgagttcctttttttggttagttagttggttttgatgttggagatgtctaaatgtctgtggatcatatactatctttatatggctgattagaagttctcagtatactgggcagaaattgtataatggtaattaaacaacaagctgtgtattttattagaagaaattctgtatcattatataaaggccttttatatgggactgtgaagtttatccagagaaagaagctccatttcttcttcgttattgtgtatattcttaagtacagccattcctgggatgaagtaggatagggtggggtgagaaggtgctgaggtcttaatgttaagtgtgtagactttgacttaactcctccatttttagctggcaactcctcctgacttttgtcatcctattgtgcctgggatcccttagttccgagcatttttgattcaatttcactagaaaataacttgctgattcctgggaacattggagaaggatagtgccccagctgtgttagtgggggctgttgacccaggcatttaactgttctttatgtagagtgttatctaatccttttgttatcctcaccttcttgtggtatcagggcctccagcttctgagactttctgtagttctgagcgggtcaaagctgctttttattagtaatcctgtctataggcaactggatctcatttttaccactttgctaccacttttctcatttttaccactttgctaccagttaatcactaaaagagaatgggagtaaatatctatgttaaaatcacatttaactagaagctttgtaaaaattctctagttgtaaaacatcattaattgttcatttccattttaccttcttgcagagctggcggagttgcctttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaaatgttgcgaatcagtatgcagttagcccattttatttgaaagtatagaaacacagacaataaaaaaatgatcaaacaatctggaagtacacacgttaaatctgggtacatataaaatcatcaaacaatctggaagtacacacatgttaaacctggatacataaaaaattatcaaacaatctggaagtacacacacgttaaatctggatacatataaaaatgatcaaacaatctggaagtatacacacgttaaatctggatacatataaaaatcatcaaaccatctggaagtatacacacgttaaatctggatacatataaaaattatcaaacaatctggaagcacacacttgttaaatctggatacatataaaaatcatcaaacaatctggaagtatacacacgttaaatctggatacatataaaaaatcaccaaacaatctggaagtatacacacgttaattctggatacatataaaaatcatcaaacagtctggaagtatacacacgttaaatctggatacatacaaaaatcatcaaacagtctggaagtacacacacgttaaatctggatacatataaaaatcatcaaacaatctggaagtatacacacgttaattctggatacatataaaaatcatcaaacaatctggaagtatacacacgttaaatctggatacatataaaaattatcaaacaatctggaagtacacacacgttaaatctggatacatataaaaatcatcaaaccatctggaagtatacacacgttaaatctggatacatataaaaattatcaaacaatctggaagcacacacacgttaaatatggatacatataaaaatcatcaaacaatctggaagtatacacacgttaaatctggatacatataaaaatcatcaaacatctggaagtatacacacgttaattctggatacatataaaaatgttaatcatttctttaagagattgttggggaaagtgcttttctttcataagttatggagatttttgtgatgttctgagttttcttattgaacatctattacttatatcaaaaaaataaaaaatttaggccgggcacagtagcttacacctgtagtcccagtactttgggaggccaaggcaggcagattgcttgactccgggagtttaagactagccttggcaacattgtgaaaccctgtctctacaaaaaatacaaaaagttagccaggattggtggtgtgcacctgtggtcccagccacttgggaggctgtggtgggaggattgcctgagctggggacgtggaggttgcagtgagctatgatcttcccactgtactccaacctgggtgacagagtgagaccctgtctcaaaaataattagataaataataatatctcagactatgcctaagctaagctagtgcttaataaaaaactacaaggtcaggcacggtggcttatgcttataatcccagcactttagggggctgaggtgggcggatcacctgaggtcaggagttcaagaccagcctggccaacacggtgaaaccttctgtctactaaagatacaaaagttagctgggcatggtggtgggtgcctgtagacccagttcctcaggaggctgaggcaggagaagcttgaaccctggaggcggaagttgcagtgagcccaggtcacataccactgcactccagcctgggcaacagagcaagactccaactctggctcaaaacaaaactaaactaaactaaataaataaataagaatacagcatattgtcattaaccatagtcactgtgctttacaacagaactcttgaacttattccttctaactataaacatgtattctttgaccaacatctcctcagctcccactccctaaagtaattgattttaaaaattataaatgcatgtgttagagaaggaagaataaacaatgtgtattttctattaaatgaaatgagaatttgttttttttccctctacaagtattgcttacaccttaaaaataataatttactgatttttctgtttctaatttggagattatgattacttgggaattctgatagaagtagctttcaaaaaagtgaccattacagaggcaaataagatttgctgggcaaggtgcggtgactcacgcctgtaatccctaatccctgcactttgggaggccaagatgggggtattgcttgaggccaggagtttgagaccagcctggtcaatatagtgagaccccgtctatatatatttaaaaaatttttaggctgggtgcagtggctcatgcctgtaatcccagcactttgggaggccgagacaggccgatcacaagttcaggagttcgagaccagcctggcctatatggtgaaaccctgtctctactaaaaatataaaaattagctgggcatggtggcaggcacctgtaatcccagctacttggggggctgaggcaggagagagccgagatcacgccactgcattccagcctgggtgacagagtgactccacctcaaaaaaaattttgtttttaataataaaagatttgcttagaagattagaaacaaggggagatgactcatacctttatattgtttgaatttttaacaagatgtggattgcattataataggaaatatatttccattaggtaagattttttttaccacttagtttagaattaattgtagattcaaagaaagttgaaaaaaaagctacttttagggaaatcccttcatctagtttcagagttttaaaaccttttatatttctgtcttttcagcgtcctgtttggttggccttcctttgtaaataggaattatttaattgagattataggtttatgatcattttatgtaaagtggacatttcattaaaataaattcagaattagagctaggtattgagtagacagggaggtatggattttgataaaagtttagggataataaagattaaattgtactgtgtttatagtgtagattttactataagattaaatgccactacagctaactttgtctctgttctggctttctgatgtctcccgtgggtgcagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggtaatctttcctccgggacttagtttccaagatctaatgtgggaactcttaaagcaaactgtatttttagtgttaagattacaggaatcttgcatttgccagattgcctctggtagacaggaatagcatgctgcctgggtttggagtggggttaggagaccgtgattagactgttattaatgtgataacccaagtttttagtcaaagtgaaagagagaaaagtgaagcacttcgtttgacttttctgcctgccg

SEQ ID NO: 79 - DNA, 156293 bp, Homo sapiens
tgacctttgattttatttttagatcttgtcaaccgatgtaattaataactcagggtagggtccctggaaatttcagtaagcatgactgtttgggggaaatgtaacatgtttggataaggggatagtgtagtataatgaaaaacatttctgcagttagcactcacttaaaaatggactttgacctgaacttaaccggtcactggagatgttcaaacagaggctaatgaaccatgtggaggtgatgtgtagagtgaatgataaatggggtgagagactgcgctaagagacgggttatttacttaggctgactacaagctctgatatatgtatttgataaaaatgattaaacattaatgaagtctagtttatcaatctttcacaaattaatgaaacagaatgctagaaaggaagatgaaaatgagagctattattttatgagatccagaatatatatttcttcctatatgtttctgctcatcacccagcagtaagagtcatcagctcatggcaagtcttgtctcaactgtgctctcatttactttcccctgcactattctctagattaatttgaatcaaatacagaaatttattggtaaacattccagaaaaacaaggaatcttctcaaggtattttcatgacagtgcttttctgggttctttgacaaaatatgacttacagtgtacaatcaatattttgtttgttttgagacagggtctcactcccattactcaggctagagtgcagtggcacgaacatggctcactgcagcctcgacctctcaggtttaggtgatcctctcacctcagcctcccaggtagcttagactacaggcacttgccaccatgtcacctactttttgtatttttagtagagacggggttttgccctgttgcccaggctggtctcaaactcctggggtcaagagatccacttgcctcagcctgtcagagtgctgggattataggcgtgagccactgcacctggccacaatacatgttgaattaactaatgatgttttcgctttccctgtggaattcaaatatttataccaatttgatacagcataatatttagttctaacatactagtggagctttgacattttggattccaagtaaatgtgtaagaacgtgaccttttcagtccacttttatatacttactgcaaccaaaaccttgcgtgtctttcctctcacttggcttgtccaggaaccttcacactttttatcctcagggccttccttattttctcctggttctgtttgctaccaactcaggaatgtaaatgaaggttagcaaaaccaaaatcatgacctctaggaccttataaccccaaatttctccctagggttacctctgtactcaggactcgcctactgtggttggtcttcaaagacttactcctataataatatttagtgtgaaatcaattaatgagaatattagggttttaatcaaaatgaaaattgagcatttcagatgacaatggaagcttaatagttttatcaactaatttatttctgtatcttattttgattgtagactgctgacaaaatggtttatcacacaaatagtttcaatttttttaacagtttattttataatctcagcacatatagttgaactgagttagcaagtgaagctttattccaacagctacattcgttcgtgtggaagtttgtgttacttaattggtaatttctaacattgcaatttggtacatgtcatatatcttttgttatattgccattttgatttaaaattaatttttaccaaataatatgttacatcattcaaaaaatattaaaaaatattaagaatcttttttttttttttttcttgagacggagtctcactctgtcacgcaggctggagtgcagtggtgcgatctcagcttactgcaagcttcacctcctgggttcatgccattctcctgcctcagcctcccgagtagctggcattacaggcacacaccaccacacccagctaatttttgtatttttacttctttttttttttttgagacggagtctcacactgtcgccctggctggagtacagtggagtgatcttggctcactgcaacctctgcctcccaagtagctgggattacaggtgcccgccaccatgcccagttaatttttttttttttttttgtatttttagtagagacggggtttcattatgttggccaggctggtctcaaactcctgacctcatgatccgcctgcctcagcctcccaaagtgctaggattacaggcgtgagccaccgtgcccggccttttttgtatttttagtagagacggggtttcaccatgttgcccaggatggtcttgatctcctgacctcgtgatccgcctgcctcagcctcccaaaatgctgggattacagtcgtgagccaccgtgcccagccaagaatcttaaatagtgtcgttcccctgcctcaaacttccctgcacaccaatttcaatggccaaaagtatgtaccttcattaaactcctttgactctttttttttttgagatagggtctcactctgttgcccaggctggagtgcatggcgtgaccagagctcaccgtagcctcgaactctgtgggctgaagccatcctcccatctgagccttccaagtagctgggactgcagacatgcaccatcacacccagaaaattttgtattgttttgtagagacaagggtctcaccatgttcccctggctggtctcctggactcaagcaatccacccacctcagcctcccaaagtgctgagattacaggcatgagccacagtgcccagactgctgacatatttctaactgatatgtttttatagctattgctggtttgggcaactttgacacttatgtcagcttcctattgtgatgatagatgaggatttagtttccttacactgtcaccataccatgcctttactgctttcctcccatcttcccagtgtagttttagcacaacttctgattaaattgttactcagtgttcacattactgtaattatgtaaacattgttccctgccaattcaagtgatgtactctgattttatttcctttcttgtacatgtttttttctttttttttttgagacagagtcttgctctgtcgcccaggctggagtgcagtggcatgatcttggctcactgcagcctccgcctctcgggttcaagcaattctcctgcctcagcctcctgagtagctggaattacaggcgcccgccaccatgcccagctaatttttgtatttttagtagagatggggtttcaccatgttggtcaggctggtctcgaacccctgacctcgtgatccacccgccttggcctcccaaagtgctgggattacaggcgtgagccaccacgcccggctttttttttttttttcccctggaggtaatagtttcttatctttttatatgcttatttttatgtgtgtctatggctaattccaccctctttttccagcaggctttctggtcagaccagattctctatcccttttttccctgcacttccacctcactgagccctttttttctcttctgatgtggactggctgttctctagtattgctgcccagctttttttttttttgagacagtctcactctgtcacccaggctggagtacagtggcgcgatctcggctcacggtaacctctgcccccccgtcccgggttcaagtgattctctgcctcagcctcccaagtagctgggattataggagcccgccaccacgcctggctaacttttgtatttttagtagagatggggttttaccatcttggccaggctggtcttgaacttctgacctcgtgattcacccgccttggcctcccaaagtgctgggattacaggcgtgagccactgcacctggcctgctgcccagctttctttcttctgtgttaaatactctgagtcctagactctggatcttcctcagttactccctgttttgctggaggacatctcctagtagcttcccaagaacacgtcatgggagaacatatttttgagacttcactggaaaataaatgtctttattctatgttcccccttgattgtttgattataaatccaggttgaaaactattttctttcaagacttttaagtgttttttcactttccactttcagtgtttaaaattgatggttgaaaatctgatgccattcattcttaatcccagtattttgtgaccagcttttgctctctggaagattttaagatggtccctgtttatctgctgctctgaaattttatgttaatgtgccatagcatgagttgttttaatttaatgtgctggatacttggtgggcccctttccaaaccagagatccatatcttccgttttgggaaattgttttatatctttttttttttttttaaataattttctttcttctggtttctctgtcccctttttgaattattttgaattggatgttattagacctctttgttgatcctctttgatttttttttttttttttttttttttttttttttgagacagagtcttgctctgtctcccaggctggagtgcagtggctcaatctcggctcactgcaagctccgcctcccgggttcacgccattctcctgtctcagcctcccgagtagctgggactacaggcgcccgccaccacgcccagctaattttttgtatttttagtagagacggggtctcaccgtgttagccaggatggtctcgatctcctgacctcgtgatccgcctgcctcggcctcccaaagtactgggattacaggcttgagccaccgcgcccagctgatttttcttatattttttattattcatttctgtgtcattttgtgttaccttatggtaaaatagttccaaccattcttatgaatttttaattgctaccattatattttttcatttctacaaactcattctgtgatttttaaaaaatattccttttatgtttcagtgattaaagaccttctctttctgaaactaaagatagtctagcttttcaaaattttcttctgctttctataaaatacctgtttcttctgagttcctttttttggttagttagttggttttgatgttggagatgtctaaatgtctgtggatcatatactatctttatatggctgattagaagttctcagtatactgggcagaaattgtataatggtaattaaacaacaagctgtgtattttattagaagaaattctgtatcattatataaaggccttttatatgggactgtgaagtttatccagagaaagaagctccatttcttcttcgttattgtgtatattcttaagtacagccattcctgggatgaagtaggatagggtggggtgagaaggtgctgaggtcttaatgttaagtgtgtagactttgacttaactcctccatttttagctggcaactcctcctgacttttgtcatcctattgtgcctgggatcccttagttccgagcatttttgattcaatttcactagaaaataacttgctgattcctgggaacattggagaaggatagtgccccagctgtgttagtgggggctgttgacccaggcatttaactgttctttatgtagagtgttatctaatccttttgttatcctcaccttcttgtggtatcagggcctccagcttctgagactttctgtagttctgagcgggtcaaagctgctttttattagtaatcctgtctataggcaactggatctcatttttaccactttgctaccacttttctcatttttaccactttgctaccagttaatcactaaaagagaatgggagtaaatatctatgttaaaatcacatttaactagaagctttgtaaaaattctctagttgtaaaacatcattaattgttcatttccattttaccttcttgcagagctggcggagttgcctttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaa

SEQ ID NO: 80 - DNA, 154635 bp, Homo sapiens
acattcgttcgtgtggaagtttgtgttacttaattggtaatttctaacattgcaatttggtacatgtcatatatcttttgttatattgccattttgatttaaaattaatttttaccaaataatatgttacatcattcaaaaaatattaaaaaatattaagaatcttttttttttttttttcttgagacggagtctcactctgtcacgcaggctggagtgcagtggtgcgatctcagcttactgcaagcttcacctcctgggttcatgccattctcctgcctcagcctcccgagtagctggcattacaggcacacaccaccacacccagctaatttttgtatttttacttctttttttttttttgagacggagtctcacactgtcgccctggctggagtacagtggagtgatcttggctcactgcaacctctgcctcccaagtagctgggattacaggtgcccgccaccatgcccagttaatttttttttttttttttgtatttttagtagagacggggtttcattatgttggccaggctggtctcaaactcctgacctcatgatccgcctgcctcagcctcccaaagtgctaggattacaggcgtgagccaccgtgcccggccttttttgtatttttagtagagacggggtttcaccatgttgcccaggatggtcttgatctcctgacctcgtgatccgcctgcctcagcctcccaaaatgctgggattacagtcgtgagccaccgtgcccagccaagaatcttaaatagtgtcgttcccctgcctcaaacttccctgcacaccaatttcaatggccaaaagtatgtaccttcattaaactcctttgactctttttttttttgagatagggtctcactctgttgcccaggctggagtgcatggcgtgaccagagctcaccgtagcctcgaactctgtgggctgaagccatcctcccatctgagccttccaagtagctgggactgcagacatgcaccatcacacccagaaaattttgtattgttttgtagagacaagggtctcaccatgttcccctggctggtctcctggactcaagcaatccacccacctcagcctcccaaagtgctgagattacaggcatgagccacagtgcccagactgctgacatatttctaactgatatgtttttatagctattgctggtttgggcaactttgacacttatgtcagcttcctattgtgatgatagatgaggatttagtttccttacactgtcaccataccatgcctttactgctttcctcccatcttcccagtgtagttttagcacaacttctgattaaattgttactcagtgttcacattactgtaattatgtaaacattgttccctgccaattcaagtgatgtactctgattttatttcctttcttgtacatgtttttttctttttttttttgagacagagtcttgctctgtcgcccaggctggagtgcagtggcatgatcttggctcactgcagcctccgcctctcgggttcaagcaattctcctgcctcagcctcctgagtagctggaattacaggcgcccgccaccatgcccagctaatttttgtatttttagtagagatggggtttcaccatgttggtcaggctggtctcgaacccctgacctcgtgatccacccgccttggcctcccaaagtgctgggattacaggcgtgagccaccacgcccggctttttttttttttttcccctggaggtaatagtttcttatctttttatatgcttatttttatgtgtgtctatggctaattccaccctctttttccagcaggctttctggtcagaccagattctctatcccttttttccctgcacttccacctcactgagccctttttttctcttctgatgtggactggctgttctctagtattgctgcccagctttttttttttttgagacagtctcactctgtcacccaggctggagtacagtggcgcgatctcggctcacggtaacctctgcccccccgtcccgggttcaagtgattctctgcctcagcctcccaagtagctgggattataggagcccgccaccacgcctggctaacttttgtatttttagtagagatggggttttaccatcttggccaggctggtcttgaacttctgacctcgtgattcacccgccttggcctcccaaagtgctgggattacaggcgtgagccactgcacctggcctgctgcccagctttctttcttctgtgttaaatactctgagtcctagactctggatcttcctcagttactccctgttttgctggaggacatctcctagtagcttcccaagaacacgtcatgggagaacatatttttgagacttcactggaaaataaatgtctttattctatgttcccccttgattgtttgattataaatccaggttgaaaactattttctttcaagacttttaagtgttttttcactttccactttcagtgtttaaaattgatggttgaaaatctgatgccattcattcttaatcccagtattttgtgaccagcttttgctctctggaagattttaagatggtccctgtttatctgctgctctgaaattttatgttaatgtgccatagcatgagttgttttaatttaatgtgctggatacttggtgggcccctttccaaaccagagatccatatcttccgttttgggaaattgttttatatctttttttttttttttaaataattttctttcttctggtttctctgtcccctttttgaattattttgaattggatgttattagacctctttgttgatcctctttgatttttttttttttttttttttttttttttttttgagacagagtcttgctctgtctcccaggctggagtgcagtggctcaatctcggctcactgcaagctccgcctcccgggttcacgccattctcctgtctcagcctcccgagtagctgggactacaggcgcccgccaccacgcccagctaattttttgtatttttagtagagacggggtctcaccgtgttagccaggatggtctcgatctcctgacctcgtgatccgcctgcctcggcctcccaaagtactgggattacaggcttgagccaccgcgcccagctgatttttcttatattttttattattcatttctgtgtcattttgtgttaccttatggtaaaatagttccaaccattcttatgaatttttaattgctaccattatattttttcatttctacaaactcattctgtgatttttaaaaaatattccttttatgtttcagtgattaaagaccttctctttctgaaactaaagatagtctagcttttcaaaattttcttctgctttctataaaatacctgtttcttctgagttcctttttttggttagttagttggttttgatgttggagatgtctaaatgtctgtggatcatatactatctttatatggctgattagaagttctcagtatactgggcagaaattgtataatggtaattaaacaacaagctgtgtattttattagaagaaattctgtatcattatataaaggccttttatatgggactgtgaagtttatccagagaaagaagctccatttcttcttcgttattgtgtatattcttaagtacagccattcctgggatgaagtaggatagggtggggtgagaaggtgctgaggtcttaatgttaagtgtgtagactttgacttaactcctccatttttagctggcaactcctcctgacttttgtcatcctattgtgcctgggatcccttagttccgagcatttttgattcaatttcactagaaaataacttgctgattcctgggaacattggagaaggatagtgccccagctgtgttagtgggggctgttgacccaggcatttaactgttctttatgtagagtgttatctaatccttttgttatcctcaccttcttgtggtatcagggcctccagcttctgagactttctgtagttctgagcgggtcaaagctgctttttattagtaatcctgtctataggcaactggatctcatttttaccactttgctaccacttttctcatttttaccactttgctaccagttaatcactaaaagagaatgggagtaaatatctatgttaaaatcacatttaactagaagctttgtaaaaattctctagttgtaaaacatcattaattgttcatttccattttaccttcttgcagagctggcggagttgcctttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaa

SEQ ID NO: 81 - DNA, 150385 bp, Homo sapiens
ttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaa

SEQ ID NO: 82 - DNA, 149199 bp, Homo sapiens
ttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattccagcactttgggaggccgaggtgggcagatcatgaggtcaggagatcgagatcatcctggccaacatggtgaaaccttgtctctactaaaaatacaaaaattagccgggtgcggtggtgggcgcctgtagtcccagctactcaggaggctgaggcaggaaaatcacttgaacccaggaggtggaggctgcagtgagctgagatggcgccactgcactccagcctgggcgacagggtgagactccgtctcaaaaaaaaaaaaaaaatgctagagacagataaaaatactcagctttcagagctaaaaactatcagtagatttctttttctgatcattgttattataaccttcctaattctaaagtcacaaattcctactttagacagtttggtcatttgtttaccagtgactgaagtgaagctatacagtaataattataaagtagctttacatgtagatgctggacatcctacaacctagaaatttttgccaactcattattttccctcagctcttttatttttttatttttttgtgagaaggagtctcgctctgttgcccaggctggagtgcagtggcgcgatctcggctctctgcaagctccgcctcccgggttcacactattcttctgcctcagcttcccaagtagctgggagtacaggtgcctgccaccatgcctggctaattttttgtatttttagtagagacggggtttcaccgtgttagccagaatggtctcaatctcctgacctcatgatccacctgcctcggcctcccaaagtgctgggattacaggtgtgagccaccgcgcccggcccccttagctctttttaactctgcagtttattgacgattttgtacaagcatatgttactctttttttttttttttttttttgagatgaagttttgctcttgttgcccaggccggagtgcaatggtgcgatctcggcttactgcagcctccgcctcctgggttcaagcgattctcctgcctcagcctcccgagtagctgggattacaagcgcctgccaccatgcccggctaattttttgtatttgtagtacagacgggatttcaccgtgttggtcaggctggtcttgaactcctgacctcaggtgatccacccacctcagactcccaaagtgctgcaattacaggtgtgagccactgtgcccggcggcatatgctactctttatggcaactataaaactttatgagtaaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcggg

SEQ ID NO: 83 - DNA, 148230 bp, Homo sapiens
aaacttcctaacaatagaagggtcttataagcctcaagaatttgtgttttgacttctgggacaagtagcaacagaaatatatgtaatgtttcatgatttcctgctcttctctctcaaagcagaatcaaaaacatagttgtatatgattgttggattcctaaaagtaaaagttgcttcatgtaatctaatgaggagaaatgctttaaatctctgactatgcaaactagtcagtgtgataagtttacttggtatttgaacagtataatcaaaagttatttatttatatattactgaaatgtattagtgactagaaaatgaaaacatatttaccagttaaacacctaaaataacacttaaccaaataatataatttattagtttttaaatattactgtatgtacttgatagaaatgcctccctttcccaatgtatgttacataaaatgttgatatgataaaaaggagcatacttcagatgagtaataatttggctacatctgtgtgactttatttagatatgtataaaaggcaaagtccacatatttaaatacctgaacatacaagcttgtaagattgctccagatctgccggattatgataggagaccgttgggttttggctcctggtaagtatattctgtccctttatctatcatattttttgtacagagaatcaaataaaatggatacttaaatttgcctgaatgtttgactaaagggaaataacctgttttaacactgttattctcagaatgcttgtattgtaaagttgattacctagatctggcaaagtctagttctaagggtttctcaaccttggcactgttgacattttagatcagataattctttgttgtgatgggctgtcctgtacattgtaagacatttaccagcatccttggtgtctgcccattagatagatgccagtagtaccctcgcaaagtctccaaatgtcaccttggggccctccagttgaaaactactggtctgagtgacttgaacgctaactttagctctgctgctgaggtaactagccgaaggcaagtcattcctactttttgagtttcattttttctacaaggagtcaagagttggatttgttgaccattaacatcacttcaggatcttttaatctatgagtccctcagctacacagcctgtgacttataaggtcatctgcttggcagtcccaaccatctggaacaatctcttttttttgaaacaaggtcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttctgctcttaaaaattactgtgtccacagaggtctacagaagaaaaaaagtaaaaaaataaataaaaattactaatgtgtaatattttagctatgcattaagttattaagtaaacttttgttagcaagactgataacctactatttataacattgttttactgtgaattgaaaccaaattaattttagaccacatcccatttgaaatttggaattacttgtgtttgtatgtcttggtgggtgggttcataaatgtggctgtatcaatacagatatatatgtagatattttaaatctatatatatataatttatggagtcatgaatcttttatattttttgagacagagtcttgctctttcacccaggctggagtgcagtggcacgaccatggctcaagcagtcctcccacctaaacctcctgagtagctgggactacaggcttatgccaccatgcctggctaattaaaaaaaatttttttttagagacatgctctccctatattgcccaggctagtctcaaactcctgggcttgtcattcccatcttggtctcccaaagtgttgggattataggcatcagccaccactccagaccagatttttatttttttgaaataggatctcgctttgtcgcacaggctggagtgcagtggtggaatcctgtctcattgcagcctcgaactcctgggctgaagcgatcgtctcgcctcaacatcccaagtattaggattacaggcatgtgtgagcacatctagctaatttactcctggcctcaagtgatcctcctgctttggtctcccaaagcgcatggattacaggcatgatctgccaggctctaaaatgattgtttttaatgtttctgcttcttttttaagcctacagatgaattttcagatctgcctcttcgagtagcagagattactaaagaacaaagactacgaagagaaagccagtaccaagagaaccgcggcagtttggtagtaacaaacggcggaggtaaacataattccggtgacagctaaagtgtttgcaaccatttaactttttaaagttgtctttttcatacccactccttttgttggtgtatctatagcttcttcactcttcttttaaagacttcttttcatatatgattgaaaaatactattttccattgggatgaaactatgatttctggtttcagtcagagttaaaatacactatttctcccttgtttttattttgggaggaaactttattagagacagtacacctggagcagatctttgttaatctggatttaatcacgaccttttgaagtaacattctccctttttaagattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcagaaactctttctttctcgagtccagtttactcctaccttttctcttttttgtgtgtggcctttgactttctcttgagttgactgtgttcggttttccacctgccatctcctcacggagatattaagccccagacctaaaacacgaaaacacaaagatgcacctttcagtctttaaaaattggtcttcgctctttgtctcacaaactgaaactactgtgtttaaaacagtaaggagctgtccaaagaaaaatggtagaggtctctatttcaataattatcatcaattgctacattctttagtgaactaggactaaggttttctggagcctatttttgtgagtggccatgaactaaataataaacacttgtgtgccaggcacgttggctgatgcctgtaatcccagcactttgggtggccacagtgggcggatcgcttgagcccaggagttggagaccagcctggccaacatggtgaaaccccgtctctactaaaaatacaaaagttagccgggcgtggtggtgcacacctgtaatcccagctacttgggaggctgaggcaggagaatcgcttgaacgtgagaagcagaggttgcagtgagccaagattgcaccactgcactgcagcctggatgacaaagggagaccctgtctcaaaaaaacaaaacaaaataaaatataagtaaaattaatttaattttttttttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattggagcttttgtgctaagtcacacagaatgtaaattgtttgctattaaagttcttgggtatctcttaagtggagcattgaattgccttagaaaacaaatgtgcattcagcccactacagaatctctgccaattccccaagggtctcagatagaatagcattcttcagtctatcttgtcagcataataaaatggcttcactttagtggatgtgatgttgatgtctggagctggtttcaggctctgagcagtgattatttgagaaacacttgggcccttttagagaatgatgtattatccttttagaaatagagaagaatctctttggtctgagacagctaaaaggaaagaaaaaaaaagaaatagagaataatcatttcaagtgggacatgttgtagagtgatattatcattctttatttaatgaagcagagtcactctgtcgcccaggctggtgtgccttggcacgatctcggcttactgcagcctctgcctcccaggttcaagtgattgtccttcctcagcctcccgagtagctgggattacaggcacctgccaccatgcccggctaatttttatatttttagtagagacggggtttcaccatgttggccaggctggtctcaaactcctgacctcgggtgatctgcccgcctcagcctcccaaagtgctgggattacaggtgtgagccaccgcacccagccagtattatcattcttttttttaaaaaaagggccttggtttttcctatctgaatacttttgaacaccgtattttttgttggtaaagagacatacttgtatttaaagttggataaaattagataagtcaaagtcctacagcccagagatggcagtgtactaggtgactgatgaaactacttgttgaggctgctggagcaaggggcaactaactattttgcaataaaattaaaaatgacacattataatccttaaaggaattcattttcttttttcctggtctttctctttgatcatgttatggttacttaggctgtataaatggagtatctctactaaaagtgaaaatgcctattatactactataaaaaaatagtatttctttaattcattgtattgttttgtaataatatttttaaaattctggctgcctgttacgtatggtagtctttatgacttctgtgtcataaagctttcgtaaaatttagcatctgtgaaaatgtgatgaggcagcattattttagatggtttcacaaccagtgaagtatctttttattttcctgaacactatctaaaaatggaatgttaaaaactaacctatgtgaggtgttaaacactctactattatttaattttattataatacttgtcacatacatagaccattcctgtctgaacatggtatgattttttttttaattaaaccaatgtcacattcattttgtcatgaaaatttcgtgtgcctcttagaataattttagataattgcagtatcataaaactaggatggggctggacatggtggctcacacctgtaatcccagcactgtgggaggccaaggcaggtggatcacttgaggtcaggagtttgagaccagactggccaacatgaagaaacgctgtctctactaaaaatatatattaaaaaaaaaaaacttagctgggtgtcatggcaggtgcctgtaatcccagccactcgggaggctgaggcacgagagtcacttgaacctgggcagcggacattgcagtgagccgagattgtgctactgcactccagcctaggtgacagagcaagattctgtatccaaaaaaaaaaaactagggtggtaagccactggtacagcgtcctaggagagatttgtgtttattgtttaaagtggtgtagcttggcctggtggctccttcctgtagtctcagccactcgggaggctgaagtaggaagactgcttgagcccggcagtttgaggccggcctgggccacatagcgacactctgtctccagataagcaaaaattttaaaatggtgtcttcactaaaattagagaaattatttttgcatcagagttgtagaattgtagtttattatttgggatctcatgtccagactttaagacagtcagttgttagccctttgaagtaactcaccaaaagtttctaatgatgtgtgatatacctgtttcttggaggtagatgctatttcttggaagtagatggtaagtagttttatgtttgatttgtagatatcctttttgggaaagttgttttcttatttttcccttgatgaataaccattttgatgattatttttggtgttgaaacaagattgtattgcttctataggttttcctttgataacctttaatcctctacctttgatttataattttatttttcagtgcgtggtctgtattttaaaccagtttaattttcctcagtaatactttttgaaaatgacgttttactctttggtttgtagataagtaaaattgccaataatattttccttttaaatacggtattttaccataaatagaaattactttttgttttgtcttgatattcaccgacacactcaagactgtttgtatgagtatgataagagacaatttgttgtgatggataaataaagaaatgtaacctgcccagtgaactcactattaccagaaatattcaagagaaactgagcaaatgttagggtagggtaggtgggaatttctgtcctaaatggaagtctgttagtgacctcttcggttcctttctaattctaacatcttattattcagtaaatattactgtgcttggtcactgtaatgtatataatacagtgagaaggaaatctactttcttataaaataaaataaatgtttgtggattgtgaatgtttttgtttattaaagcagcagtatagcatatgatgcttttaaacttaaagtttacatttgaagagtctattaaaatgttttttagtgtaatatataaattaaatgacaaattggatgtgaactgtgtaatcgcagtgttctggattaatatactaaatttatttatttctgtcctctggcctagggttcaccagtaaagccagtagccattagggagtttcaaaaaacagaagatatgagaagatatttacatcaaaacaggtttgaaaaaccaattctacttaatttgtttctgtcttaatcatgagagcataaagtaattttggttttatgcagatctgtgtgtaataaagatgtttacatggcatgtatttagaactgagcgacggtgtgcttttttgtactcatgccatagaaaaggtaaaaactgatttgattctaaattgagaccatctaaatcattacctacacagttaatcgatctgaagatacttagtagcaatgagattttgtggtgaagctatatggattcatgcacaaaaagggctaaaagaatttcaggactgggcatagtggctaacacttgtaatcccaacactttgggaggccaagacgggaggcttgcttgagcccaggagtttgagaccagtctgagcatcattctacccctctacaaaaagaaaaaaaaatagcctggcatggtggtgcatgcctgtggtcccagcaactcagaggctgaggtgggaggatcgctcgaactgggagggtgagactgcagtgaacccagtttgtgccattgcagtccaacctgggcaacagagtgagaccctgtctcaaaaaaaaaaaaaaatacaaaatacaaaaaacgaatttcgagagttctaattttttttaacttacatttttgactggataacagagagaaatagtcagagacagtgatatgtatcaccagtcctgtctccgttaatacactctttccactgtacttggtgcctctcagaatattttgaaaattaggccctgtgcggtggctcatatctgtaatgccagcactttgggaggctgaggcaggtggatcatttgaggtcaggagttcgagaccagcctggccaacgtggtgaaacgccgtctctactaaaaatacaaaaaatagctgggtgtggtggcacacgcctgtaattccagctacaggtggcacatgcctgtagtctccaggctgaggcaggataatcgcttgaacccaggaggcggaggttgcagtgagccgagatcgcaccattgccctccagcctgggtgacagactgagactccatctcaaaaaaaccaaaaaaagaatattttgaaaattagcttgatcgtttagagcactgcttctcattcttgaattccagaatgtttcttgccatgaagaatttcacagtagttggaaatttcagcctttagttctttgccttctggttttatgaagtcttggtacacctattcttaagtgacggtgaatttacgtagttcttatacttgacaaggtattaaaggtaactcgggggactgagctatagatggaataaatgtgtagggagaaaaaagacagacatcactgtgacatttatactcttatcacttaactcatggagatttaattaaatttgatatgctttgaaatttatttcagaatgtcttttcagttgccacgtgtccttttattgagagtgtagtcttttaagattccagttttatgcaggagtttccagttacattccccaccttgagtgggcctgcattttatatctcctgcccctctcacgtcctgcatccatcataggtgaagctcaagagctccaggatttagtagaaaccctcaaggtaaaagctggctctttcactcagttaccttatgtgttagttttctgttgcttgtgttacaaagttagcagtttagaacaacacctctttattatattatacttctggaggatagagcctgggcaggccccgctgggttctctacttagaggccaaagtcagggtatcggctggcctggattctcatgtggagactgtggaggagaattcattttcacgctcctacatcttggcagaattcagtttgatgcagttaccggtccccattactgaggtccccattattttcctggctgccagctggtggccattcttggtgtttagagcccactcacattccttcttcatggctccctccatcttcaaaccaggaatgacaggccaaatcctccttatgtttggaatctttcttacttccctttctgccacatctcgcaaattcttttgcttttaagggctcgtgattatattaggtcaacctggataatctccccattttaaggccagctgattagtaaccttaatttcatctgcaaagccttttttaaatgtaatacaacagcattcactagagtaaggccagggaccgagatcgtggaagccaaaagtctgcctaccgcatcttagtccagagttcctgtttttacttctttttgaaggtctgtggattctttattttcatggcaccttagcaatacattttaaaagcttgttttattttattcagcattttggttatttccattggaagagtcattcagggcgtttagtctgccacagtgctggaaactaaagctaggattacatgttttgttttgttttgttttgttttgttttgttttgttttgtgacagggtcttgctctattgccttaggctggggtgcagtgttgtgatcatggtcactgcagcctctacctcccaggctcaagcaatcctcccacctcagccgctggagtagctgcaacttcaggcgtgtgctacatactcagcaaattttttgttatttttaggagagacagaaatctccctatgttgcccaggccggtctcagactcccagattgaagtactaaccctcctgctttggcctgccaaagcgctgggattacaggtgtgagccactgcacccagccatgattactgtttaactcggggttccatagcacagtccttggataagaactccatacttgatcctagtaaccagttaggctctaggatcaatatatacttcatgtttttaattagcaggtatttgtgaaatatctactatgtgccaagttcctttccagatgttgggatatagctatgaacttagtcaaaattcccgcactcctggagcttacattcaagtgaaatgttgaattcgaacctaaaaagacacagtcgcctcagaatgactgacagctctcagaccagcaagacttgtctctaatctgaataacatgttaacaaaaagactctacctcagcagtctgtcagttacagcaactcaaaaacattgagtgagcataaggaatcctctgctagtgagctgaaaaggaaagcttgcttacccgtttttttcttccagttcttttcccctaccctcatccaacacatacatttcttcccacctaccactcccctaccgctacccacatagagtctaccctactgggagatcataaacatagggagatacaataaataaaaagtgtgaatgttttgtagtatttgccaagatggattatgtaaatttgaaattgaaactagcaaaaattatgttttaaaaaaattgttaaaataattttttatgggctgggtgcagtggcttatgtctgtaatcccagcactttgggagcccgaggccagcagatcacctgagctcaggagttccagaccagcctggccaacatggtgaaacctgatctctactaaaaatacaaaaattagccgggtgtggtagcttgcacctatagtcctagctacttgggaggctgcggcaggagaatcgcttgaaccctggaggtggaggttgcagtgagccgagattgcaccactgcattccagcctgggtgacagagcaagactctgtcttaaaaaaaaaaaaaaaaaaattatagggcctacttataatttgaatagcattttagttcaggagagatgataataccagactaggttctgtaaagtgtgttatagcttctataagaagcaatatagaattaacatttagataaaacctggaagtttttttgtttcatgttatatagacacagccagaaaagctactcacattaattatgtgattttgtaaataaagaaaaacagagaaggcagtttagtctgccttatactggccaggtgtaatacacctgtattacctgtatagtgctgggtgtaatcccagcactatactggccgggtgtaatacacctgtaatcccagcactttgggaggccaaggcaggtggatcccctaaggtcaggaattcaagaccagcctggccaacatggcaaaaccctgtctctactaaaaatacaaaaaattagttgggcgtggtggcatgcacctgtaatcccagctacttgggaggctgaggcaggagaattgcttgaacttagaaggcagaggctgcagtgagctgagattgtgcccctgcacgccagcctgggcaacagatacgccatctcaaaagaaaaaaaaaaagtctgccttatagagataaaagtctggtttacttagctcaagtaagttcaagatttaaaggagatacatacatgttacctgcatttttgtttttttatgtctcaatattccacactttttcgggagagggtgctactgtcattcattcaagcaatatttcttaagcactatagtggttctgtctctgttccaaatccctgatattttagagttactttttagtggatgtagacaaatatatgtaacaagcatgtttcaggtactgctaggtgctatgaagaaaaataaagcaggataaaagagatggtagggtgagggaagagtgcaagtaatgttagatgccatgataatatttcagtagaaacctgaaaaagagcaaacattatggatgtctaggggtgaaacgttctaggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgagaatggttgttgtttttgtttttttgagacacgtctctgtcacccaggctggagtgcagtggtgtcatcatagctcataagcagccttgatctcctggactcaagatcctcccgccttggcctcccaaaatgctgggattaaaagcatgagccactgtgcctagccttgaaaacagtgtttgaagaagtatagagaggaatgaataacatcacttactgctcataggttttttgtttttttttttcccagatggagcctcactctgtcgccaggctggagtgcagtggcgcgatcttgactcactgcaacctccacctcccaggttcaagcgattcccctgcctcagccttctgagtagctgggactacaggcgcgcaccaccacacctggccagtttttcgtatttttttagtagagacggagtttcaccatgttgaccaggatggcctcttatctcctgactttgtgatccgcccgcctcggcctcccaaagaagtgctgggattacaggcgggagccactgcacccggccctgctgataggtttaataaggggaggactaagaaatagctattggatttggggatgtcaagatcattgacagacttgtgaggtgaaagaaagttttagtgaaactgaaaggacgggacgcagattggattgggtgcaaaatacagtaatgagataaagtggaaacaatgggtttgactggctttttagagaagtattgtaaaaagagggtaaatgaatctatgtacttgtaatcccagcactttgagaggctaaggtgggtggtttgcttgagcccaggagttcaagaccagcctgggcaacatggcgaaaccccatctctaccaaaaatagatgaaaattagccaggcatggtggtgcacacctgtagttccagctgcttgggaagctgaggtaggattgcttaactctgggaggtggaggtctcagctgagatcgcaccactgcattcaagcctggacaacagagtgagatgagactctgtcaaaaaaaaaaaaaaaagaaagaaagaaagaaacataggtagaaagaagatttaaaggagatacatacatgttatctgcatttttgttttttatgtctcagtattccatgctttttcgggggagggtgctactgtcattcattcaagcaatatttcttaagcactagaaagtgcttaagaaagtagaaagaaagtgtgtattaaaaaattgaaaagcggctgggcatggtggctcacacctgtaatcccagcactttgggaggctgaggtgagtggatcacctgaggtcaggagttcaagaccagcctggccagcatggtgaaaccccgtctctactaaaaatacaaaaattagccgagtgtggtggcgcatgcctgtaatcccagctactcaggaggctgacgcagaagaatctcttgaacctgggaggtggaggttgtggtgagcgagatcgtgccactgcactccagcctgggtgacagggcaagactctgtctcaaaacaaaacaaaacaaaaattgaaaagcatttttaaagtttagtgttcaggttagggcacataaacacacttgagttggtttatttggtcctttctatgttttgtttcagttcatctacagatggccgctaaaagctatgggaaattttaacagtgaaattagtaatctagggagaaagttgcagttaattcctgttactctaaatgtgtaatcagggcgtggcgtggtggcccacacccgtaatcccagcactcggaggcctcggtgggtggatcacttgaaagctcaggagtttgagagcgacctgggttaacctagcaaaacccggtctctacaaaaactgcagaaataagcctgggttggttgacacacacctgtaggccagctgttcgaaaggctgaggcgatattatcgcttgaggccaggaggtcgaatctgcagtgagccatgatcacggcattgcactccaccttgggccacaaaaaaaaaaaaaaacaaaaaaaaaacggctgggcgcagtggctcacacgcctgtaatccaattactttaggaggctgaggtgggaggatggcttgaggggcaggagtttgagaccagcctgggcaacataataagaccctcattgccacagaaaaattaaaaaaaaaaaaacaaaaaaaacaaagacagctgggcgtgatggctggagcccaggaggtcaagactgcagtgagccatgatgatgggttttttttggttgccctaattagcacactgatttcagtgcctgtagatcagcctgataggctaatcatcatagttttggaggccacgtcctaaacgtcagacagtaactaatcttgccagttttagtttcagacacaaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttccctaaattgatagggaatattggtaacgtgatcctcatttttacttttgtatgcacaataacgctttggttccagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaagtgagtcgtttgaatgatgctgttcaagctgctgactggctaagtgcttatttgtttggtcaggcccgttggtttttattgtccattaaaatgtcgaccatttttctctctgtaaggaatcttgactaaatagagtgtctcttttacttgtgtctatctgcatgaggacagaacaagtgattatcttgttaacggtaaatctgtcattggacatgtcactttactatccagctgccatttcctcaatttctagtgtcatagtaaagatcagtaagatgaaagtgaaagtgctgtgtgaaccataaaaggcccgtgcagatgcaaactgttactcagacctctctccagcttcctcgcttttgtaaataacaaaagtttgctagcctcacaggcttaatcctttgcaggaactttgatttgttcctttctgctctccacacacatccaattaacaacgccattaatatttcttaacgttttgcagcctctatagtagtgcctgaaatgttgtcattttattttacctgtattgcttatctttttgttctgaaatcgtcattttttcttcataattaattatttgtaattttgtttacttaatatctgtctctcatttatctgtaaactccatgaaggtaagaaccatgtctgttttacttactgctgtgtccctagaccttagcaggtcttagctcatagtaatggtcaataagtatttgttgaatgattaaatgaatttttcttgtccactaaagactttcctgtatttcatactttaactagagaccatctcctttaagtacgatgcgtatgtctgttttactgttttacctgataaactctttttttctgaatgtaccagacccttggcaatgacgtttaactctctttctcacctgattcctcttcatccaacaagttcccttgtctcttgttttctataaaaatgcaggcaaatctggccgggtgtggtggctcacgcctgtagtcccggcactttgagaggccaaggtgggtggatcacctgaggtcaggagtttgagaccagcctggccaacatggcaaaaccctgtctcaagtaaaaataaaaaaattagctgggcgtggtggtgcatgcctgtaatcccagctaaccaggaggctgaagtggaggaattgtctgagcctaggaaacggaggttgcagtgagctgagatcgtaccactgcacttcatgcagcctggttgacagagtgagactccacctcaaaaaaaaaaaaaaaaaaaaaaaaagtaggcaaatcttttgaccaatagcaaaaatactaaaattaatattcctacaagcagaagttcacaaaggtacctccctccctcaaaaccttgtctgccctgagatgtttcttctttttgtgccttttcaaccctcataagaattgttaatgtactaatggccatgttctcttgtcctcctttatctctgtcattgtattttcacacaagtcatctaatactatacatactatatctcctaatttgtctaaccatttctctttcccttaagtccctgcttgatttgttactacatacaaacttttttatatagttctcttgaaactaacggaaatactttattggtttattcttaataggtcatttggaggtgttcaggtttcacagatgaggaagctgtaggtctaggaagattaagcaatgtggtcatttatagtacatttgttttcttaatcaggaggcaaacctagacttctgaaagcctaacttggttcgtccatttgacttgatagacctttatggaatgctggttgtacaaggaatataaagatgcataaaatacaagccctgcccaccaggcacagcttagaccttatcagggaaataaacacaaataaaacagaaaataaggcagcttataatgaaagtgctagttttatattcaagacagtagaagacttagagaacaagtatcatcagaattgacctcaaaaagaaattatagggaccctgaagagtgagtaggtaggatttagccaggaagaaaagactggatgatggtgtaaaggggggttcgttttaggctgaggaaatctaaacaggatgggagctgggaatggccttgtgtgatttgtagatttaaaataatggcacttgcaggaaacaccagctggcctggagagtttgtattgaagacttatgggaaaaatgaattattgagatgatgataatcgtacttaaaacttattgaatgcttattatgtagtaggcactattttaagtacattatatatatttactcatttaattctcccaactctctttaggtaccattttttctttttttttttttttttccttttaattacatttattttaatgctgaatttactcccgtgccgtaagtttttgtttcttcagtttcttctgggatatctttttcttctgggcaacctcctcttctggtttaggaacaatctgttccttttccataaggatcatctcaatgtggcagggagagctcatgtatgggttaatccgaccatgagctctgtaggtccggcggcacatctcaggtgctttgttcacttggatatgctcaatgaccagagaatctacatctgaacccttaagttcagcatcactctctgcatttttaagcacgtgcagcaaaaattcagcactctttctgggccaccgaccttgtgtccagccccactgcttggcctgcgcacacctgccaactccatcattgtaacgtcggaatggtacacgctgtttctgtaaagtgacatctttcagatacttcgtggcttttcgtatatgcatacccttggtggcctgagcagttccacgagtgttcttaaagtgaacacgaagattggaacctcttgatttgcatgatttcgtggggttctccgggtcaagtgaatagcgaaccatttttcacagattacctcaggctgcttagggaaagagcccattttttctttttatgaacaaggaaacacgctcagagagaataacagtttactaagattaaatactcaggaagtggcaggattaaaatcctgtgattagaacaaggcaggttggctctgaagcctattctgtgagcacagtctatgctgcctctcggtaataatggttaacactgaatcttaagtgctgttctatgtgttttgcataaattaacttactcagtttgccttccgtagaagtcacacagccagtaagagatagtcaacttgtagagagtcttgattaaatgtcaaattagtgttggatcttgatctattaagtaaaagagaacacttgagtttcaaagcaggaaaaaacatgagaagagagagacttctgaaaaactaattgacttgcgttagaactggttaggaagaaagactagaaagaggaaaatgaagaaggaaattgcaatagttagactagggtgcaaaataaggcataaaaaccagatggtttctaaaggtcctaagggttggcagtattgcagtgacaagagcctaaattcagaaatctctgcatttgaatccagctttgccacttgccgtgcgcttgactttcagaaagctactgagccattttatgctgttaggttcctcctgtgtgtgatatttaactattaaatattaactatctcagaattattatggatatacctaatgcttaatactagtatggtagatgctatatcccctattactataataaaatggatttgctgaattacctataagagagatggtgaataaatcacagatggtgaataaatcactgaagagggtgaaaaaaaagaagctcccaaagcaaggtttggaggctgaaagatggtttcaaatgagggtctagcattgtggaaagaacacaggctttgcagtcggaaggcaggcccaaaccagttatgctgctgacgaacttggagaccttgcacgtgccgcataacctctcttctcgattttctcatctctaaatgaatatgatgatgatattttatctcacacagtagaagaatcactgaaatactgtgtacacagtgacatacagtagagcacgttgtaaagcagggaccacaccaatgctataatgttattattagattattagacatcacacgttggagaaaatagccagttagtatgggacattgtgagtttgtttttgaatgtgtcagatatgaggtggagtggggtttccaagtagagagtttccatagacagttgaaaacacaaacctgagatttgcttctagctaaggttattagcattcgagtgatactaaagccattagagggagagaataagttcatcgagtaagaggtcaatattctgattataaatgtgtttgtgtagatatatgtatagtttttaaaatttctagctaaacattttctaactagtaaatctagaaaaatgctataaacaagaggtaaaaaaattaatttgagtgattattttagtaaatagaatttgttatttgcagtgttccaggctctaaccaacttccttttttggggggttttgggattatacagcaaaaagcatcacaaagtccacaaaaacagcacccgctcctagatggcgtagatggtgaggtaagttgatgtaatctccttttctttggagttgattatttttgcaatggaaatgaaatgtttacatgtaattgtcatgttttcagtgctcggaatattgccatttttctttttccacctcacaatattctccttatgagggagatgatacaagccaaggagtttactagaatctatagatcaaggcttttttcagctatacacatccatctagagatgatatttccctccctgacccccaccagaggcaccgtccccgtctcctccacttttgaagcgttgtgtgtagagtcctgggagctttacctggtacaggtaaatggagtggctactaaacaaaaaaagactcttacataggatttcagattcagtgctatcaatgataacacttattttataatatcaaatagtacatttttcttacagattaacagaaaataaatcacttaaccttttaaaaatctacacacctcttttgatctgttaaaatgaagcttactaaatgtttttcttgtagttggctttctcattaaccattttccctttaaaaacctaccagttttttctttttctttttctttttttttgagacagagtctcactttgtcacccaggctggagtgcagtggcgcgatactggctcgctgcaacctccgactcccgggtccaactgattcttctgcctcagcctcccgagtagctgggactacaggtgtgcaccaccacgcctggctaatttttgtattttcagtagagacggggtttcactgtgttggtcaggctggtctcgaactcctgacctcataatccacctgcctcggcctcccaaactgctggaattacaggcacttaattccactgcgcctgacccagtttgttttaatttatgatcattacctccttgaaaaatgcataaaagcgttgtttcatgtgaattttgactttgcttttcataaaataagttatttgaaaacctaacacgtggggctttacaagcaacaattttcagtgtttttaaagcacaggagtttctggtatggaaaagtgtattgtttgaaatgttttcaattgtccattagaaaggtttttaaaaagttttatcagacatagaactacttctgtttttttatgttagaacattatatatttgtataatacctcaaagattggctccagcatgttcacttgtcttttcttcacctggtaataatactaacacattttcgacaaccaaagtttgataaatttaatgtgtgttttcttttttaccccaatatttccttcttgatgattgttttcaagtaattcattctcaagaaaactaaagctccacaggaaaataacataaacagttctaaaaattgtaattgtacttttcattttgcttaagaaagaaaatgaagagatacttagactagaaattatgactctgggcttcttgtttgttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctgctgcgtgagctgcatgcctcagcatgacattcctgttacatcagcttccgtggtctgttcgcattgctgtgtattccacaaccttcatttcctttgagatggataaagcaccttttaactgggcggtcttataggtgaatacaatcatcacactctagagttttagtttaagtgaattggcctaagaagcgaataataagttaaaaatgtagacaaatattgagagcctccgacgatccaaacacttaccaaaattatctcatttactcctcgcagcaaccttaagagtgaaggttaaacttatcacctttttacaaatgattactgaggcccagaatgtgacttgtccaatgtcgcatagacagtaagtgcaaggctgggaatccacatctgtctggctgatgggagaacctgcattaaacaccatactgaaactgaaaaccgtttaggaaaccgaaggtttaataacacatggaataagtggtataagtctgagtgccaagacttttttgtcaacaaaacagtggaatttagaaaaacaacaacagcaaaatccccttagtgcgtaacttgaaattcccttcggccgtttgtcaaaacacactcacttaagtcttagttctcagtattcatatctgatcctccaaattagacggcctttaaaacacatctcacatttctttgtctgccaaatagtgtccaaccaacactgtgcaaaaagagtcgtattttaaataaaacctcatattatcaaaactgtgcttcagaaggctcccgttgcttagagtgaagtccgaacgtggcctcgaagctccctcgtgctctactgcctccctctccagtctcctctctgggcttgtgccataccagcattgtttccagctcttcaaatatcataagccctttcccatctcagacctttgcaaatgctgtttcttttacatagaatgcctttccctccctgcatgtaccccttgattaattcctactcacctatcaggtatttgtttaaatgttccatctttaacatgacttttcggcagcccaccacccttaaatcagcccacagtttgacagttaaataaactgacaggagctccagtgcgtttgatgaaaaggaggcccgggaagtatacatagtgtattactgttgtcacggtaatttttttatcatggtagttttatttgggtgtttattattttattttgtatttttaaatttaattttattctttatttttatttatttatttaattattttgagacagagtctccctctgttgccgaggctggagtgcagtggcatgaacatggttccttgaagcatcagcctcttgagtagctgggactacgggtgcatgcaccacacgtggctaatttttttatttttttgtagagtcagggtctcactgtgttgcccaggctggtctctaactccagggctcaagcaatcctcctgccccagcctcccaaagtgctgagattacaggcatgagccaccgtgcccagcttgtttattcttttattatctcttttctgttggactactagactataagcttcatgaacacaaggatattctattttgtcttaatgtaccttaatacactccatccctaccacagttcctgggatatattaggtgctcagtaaatatttcctgaatgaacatataaattctgtgcatctactgattattaaattgttttgtgatgaaaaggtctgatgaacgatatcataaggtaaatgctgaatttgatttaaagaccttgaaacttacgatttgaaatgaagatttataacagctaatatcagtttacactgacattgtcttcgggctgcccctcaagcttctattaatatcagtttacactgacattctcttcgggctacccctcaagctcctgttaatatcagttacactgacattatctttgggctacccctcaagctcctgttaacatcagtttacactgacattgtcttcgggctacctctcaagctcctgttaatatcagtttacactgacattgtcttcgggctacccctcaagcccctgttaatatcagttacactgacattctcttccggctacccctcaagctcctgttaatatcagtttacactgacattgtcttcgggctacccctcaagctcctgttaatatcagtttacactgacattgtcttcgggctacccctcaagctcctgttaatatcagtcacactgacattctcttccggctacccctcaagctcctgttaatatcagtttacactgacattgtcttcgttctgcccctcaagctcctgctagtatcagttacactgagattctcttcaggctacccctcaagctcctgctagtatcagttacactgacattctcttcgggctacccctcaaactcctgttgctttcgtctatatcaggtctcattttaaaagaatatgaggctcattttacctcttcttcctccactcctagttttcctttttatatttgacattggcagtagttccagtacctttgattaaaaagcaggcccaggaaatctaaaccccagaagtatacacagtgtattaccattgtcacagttttgctctttggtatatttttatcttcattatttgctgccttaagatagattttgtgatacatataatacattgtgtgttacatgctgcttttgttaaataaaaatatgttaattctcattaaaaatacagttgtatttatttcattgaccatatacataccttttcctaaacacctgtttgttttcttgttcatttatctcatagtttagaaatttatggtcctagtttaaatttttaaaaattacttataaagacttcactatttttaagctcttggcattttgttgttttaataggtaaaaccttatccagggctctttgtgaaagtattgtcttctctgatttccactctccatgtggcaaatgagaaaaattgtcatgttttgagcacctcttacctgtaatcaaaattctatgtaatactttaaatttttgtctttttaattgacaataattatatagatacaatctatctctaatacagctaaccagttgttatgttggttggtgaaagataaaggattcgaagaaaagggaaattccaccttcccctcttatagtcattaggagtttcacagaggcagagatgaaatgccggttcctcctttaggttgatgcagaatcctcatgtcctaattataatatatataatttggattaatgttgaaaagatattgtttttattgatgccagttctgcttggttaaaacccctcatcgtaggaacaggactcactagtttcaaggctactatgctaacaatgttgatgttctgttttatttctgcataaaatcatttttcagaaatcatgcctctcatttcttgattaatgtggcatgaggtattgagactatcctgaattatacaagtggaaaaactgtgtccatgggtttttgtcccccaaatattctcttcctgccctgtcagtagcttagtaaaccatttgaaagatcgtcagtgacctttccttttctcatttcactagtcagatctgcctgcctgacatttgctaacataaatgctgccttctgtttcttctctttctcatttgaaatgtagtcgctgtcagggttgaatcaagtgggctgtgctgctaccctgcctcattcttctgccttcacgcctcttaaggtatctcttgttattgtaattcaccaggaagtttggggaggaggtggatataaggtcttgaattttttggtgaattgatctaacaatctgaaatataggatcgcataaatatacctgtttatggaactatttgtttaacattgatttcccttgaaattttttgaaagttttatgatgctagagatagtcatagagctcacattaattcttcgtattcagattgtttgatgtgtcattctgatttttttatcaaaggtgtttttcttgtgagttattatttcactttggttagtatataatattgaattaactctgttgtctaatgtgcatgcaaaataatttgagtccaaaaaaactatcactaccaaaaccttctacagtaggggtcaaccaactatggcccctaggccacctgtttataagtaaagctttatttttacatagccagtcccttttgtttatgcattgcctatggctgcttgcacagtaaacagctgaggtggaataattgtgaccaacatcatatacctacaagcctaaaatatgtacagtctggccctataagaaaaaaaatcgcaaacccctgctttttatcagcaataatgtcataagagatgatacattccaccttctggaaaaatttaatctaaactctaaaaattaagaacctgtagtattttattttttgaaggcctctaggagtggtaattccatatttgttatcactggatatgtacaaaatgatcaataattctcactgtcaagaagacctttgtctaacttacaactgtcctgctgtggtttatacttcttttctttccagagtggagattttctagttatttagcattttttaatgtaagaatcctttttttttttacacaaaatacaatatttttttaatgtaagaatttaaaaacaattacgatgccatccttagcttcttcctaaataaactcagattcttttacatgcctttcccagactgttcatctttaatgaattttcacaagttctgtgccctccattctggcttcatggtccaaactagaaatacatccctcgttagagcttgctcatttagggtgatttttaaatttttggtcttcattttgctcagtatccactggaattctcaaatattttagttatacctcttctatgtgttgagacagggtcctgctctgtctcccaggctggatcctccctccctagcctcctgagtagctgggaatacagatgcgcaccaccatgcctggctgactttttaagtttttgtagaaacaaggtctcactgtattgcccaggcgggtctcaaactcctgggctcaagagatcatcctgcctcggcctcccaaagtgctaggtgtcagccactgcgcccaacctccttcaacttctaaatgacagttactttccacgtgttgtattctttattttttcttgaatatttaattttgctgtttgaatatttttacttgtctcatgtaccagaatactttcaaattgttgcattgagccaggtacactggctcacacctgtaatcccagtgttggtagcccgagggggaatacaattgaggccaggaactcaagactgcagtgagctgtgatcacaccactgtaccccagcctgggacagtgcaagactgtgtctctaaaaacattaaaaccgaattcttgtatcatgtcctttttttttttactttttaatttttgtgggtacatagtaagtgtgtatatggggttcatgaggtattttgatataggtatacagtgcataataattatatcaggtaaatgggctatccatcacctcaagcatttatcctttgtgttacaaacaatccagttatactcctttagttatttttaaatgtacaattaaattattgactgtgatgaccattttgtactatcaaatgctggatcttattctttttattttttttggacccattaactgtccccatttccttcccccaccctcccactacccttcccagcctccggtaaccctcagtttagtctgtctgcattgtgcttttttaaatgctgaccccaactttttttttttttttttgagacggagttttgctcttgttgcccaggttagagtgcaatggcacaatctcggctcactgcaacctctgcctcctgggtttaaagcgattctcatgcctcaggcttccgagtagctgggattacaggtgcccaccaccaagcccggctaataacctcaactttataacaactgtaaatctgagaaacctcctctggttattgttgagcatgccctacatacctggatgcctcctgaaaaaacttcataattctcttccatgtgaaccctttgctagccgttctcaactgggatccttactggaacaacacagaaaattatttcagcaactttttttcaaaatgatctcaaggaaggtccataactggcaccattctagatgtatgggagagaagttaatttgttgtactccatgaacaccttcgggcattgtggcttattcagagtcataactgagagttgttttgactgtgccaaaagttgtgtggtccagacagaccacagtgtcttgttctacagtgactgtcatatgagattaaaaataaaacttcactagatttaagatagataagtcttttttttctatccgacctgctgtactgtcaaattattattttaaaagatttattctttatttttttagtatctctattactttcacagcaattatacattatacttatgaatttatttcttttattgcttagctaggcttaaaagttgagtttatatcagttctgggtttttttttctttccattgcctcaattctctagtgagagattatttcttaaccttttttttgctctccagttttccaagagttcccaaatgtagttaatggcctcacagtgatttaagctaatgatttttagtatcctagaatgcaagtcacttagatttatagctttaataaaaatacatttcagaaaccatttttacacgtctcctctcctctggctttgttttcatcacgcccagtagtatattatctgttgctgtttctttcttttttgttttcctttgagacggactcttgctctgtcgctcaggctggagtgcagtggtgagatctcagctcactacaaacctctgcctcccagtttcaagtgattctcctgcctcagcctcccgagtagctgcgattacaggcgcatgccaccacgcccagctaatttttgtatttttagtagagatgggattttaccgtgttggccaggctggtttcaaactcctgacctcaggcaatctgcccacctctgcctcccgaagtgctgggattacaggcgtgagcctactgcgcccggcctgttgctgtttcaaaccgaaggagagaacattcgctgcccttcattgttgtttcagctcttctcatctcataaagttgcctgttaactttctccttttattccttaatacttttaaatttctagtctatgtcctgttaataggaagtgttttttaaatttctagtctatgtcctgttaataagtgttttttaaatttctagtctatgtcctgttaataagtgttttttaaatttttgaaaatattttttcctccattgtctagaataatctctaccttgaatgtttctctttttgtattattggtccttgaacatgtctttgtttaaccaattttctacttattcacaaccctggaaaataaacatagtcttttacttccttgtaaagatatctggcttttgcctcatttacctgttcattccttttaccagtttctgttactcttgtttgaattaaatttcttatttaaatttccattttttctcaacacccagaacttagtttacttgcatctataaacccgatgaacgtgtcttttccacttaagatgtgaacacactgccttacgagctcagctcactgtttaaatcttagttctccacctgtgatatcaaactaaggaattgttaccagaaaattgtctccaagtgagtcttgagaattttctcaacatatggccttggtttatttatttattatttatttatttatttttagcagttaaaattatttgtcctcatttatctgacccaactgtaagtagcgatgtaagagttctgaaaatattgaaaccaatggtagggaaagtatgggagcagatttgtatgtttgtgttaattttagagtcattatgtccagaaatgtgccttagtcgtatcataaagttataatatatttagattatatttcaaggcaattagatgtcaaggcctaaaaaactattaatgttattctagcttttcttttatttatttatttattttgagatggagtctcactctgttgcccaggctggaatgcagtggcgccatctcggctcactgcaacctccgcctccatgttcaagcgattctcctgcctcagcctcccaagtagctgggactacaggcgccaccaccatgcccacctaatttttgtatttttagtagagacggggtttcaccatgttggccaggatggtctcaatctcttgaccacgtgatccacccacctcagcctcccaaagtgttgggattacagatgtggcccatcgcgctcggcctattctagcttttcttaactgtactcccctgccaagtcttcagcagctttaacctagtcaacctacatttctttgtaaattagcttaactacatttccctttctttaggtaagctttgtaactgtttggctagttcttcctcctttttacagttcttttggtcaatgaattgaaaatgtcttggactcaaatactagtgtagaaaatatatctatcatctcttaaacatcttctctcctaaccgaaattaggaaacctatattactttttaaaaatattaaattttattctccagagaaaaaagtactttagaaactattatggagaaatactattagaaaataaaatgttgctttttctttctcatatatttcccagtaacattttctgtcttaggatgatcatttttcatagtcttaggaagagcttgttaaataatggactgtctttatataaacacaactaggccgggcgtggtggctcatgcctataatcccagcactttgggaggtcgaggcaggtggatcacctgagggtcgggagtttgagaccagcctgaccaacatggagaaaccctgtctctactaaaaatacaaaattagccaggtgtggtggcacatgcctataatcccagctactcgggaggctgaggcaggagaatcacttgaacccgaaaggcagaggttgtggtgagctgagagtgctctattgcactctagcctgggcaacaagagcgagactccatctcaaaaataaaaaataaaaacagctgggcgtggtggctcatgcctgtaatcccagcactttgggaggccgaggcaggcgaatcacctgaggttgggagttcgagaacggcctgactaacatggagaaaccccgtatctactaaaaatacaaaaaaattagctgggtatggtggtgcatgcctgtaatcccagctacttgggaggctgaggcaggagaattgcttgaacccgggaggcggaggttgtggtgagctgagatcgtgccattgcactccagcctgggcaataagagctaaactccatctcaaaaaaaaaaaaacaaaaaacaaaaaaacaaaaacttggcttttaaaaatacagaattaattcatttcaccaaatcctcatttctttttcttcttcttctttttttttttttttttccaaagggggtcaggccaggcacggtaactcatgcctataatccagcactttgggaggctgaggcgggtgcatcgcttgagctcaggaggttgagactaacctggctaacatggcaagacactgtctctacaaaaaatgcaaaaattaactgggcatggtgatgtgtccctgtagtctcaactacttgggaggctgaggtagaaggatcacctgagcctgggagatcatggcattgcaatctagcctgggcaacaagagtgagaccttgtctcaaaaaaagagagagagagggagagagagagtctccctctgtcacccaggctggagtgcagtggcacaatcattactcactgcagtctttaattcctaggctcaagcaaccctccctcctcagcctctacaggagcacaccacaatgcctgaccaattttttagacgttttgtagagacagggtctcactatgttgcctaggctggtctcaactcctgctctcaagtaatcctcgcacctcagcctcccaaagtactgggattacaggcatgagccactgcacctgacccaaattctcacctctagacttaatcgtgaaggagagttacctgttttttgtcttttataatttcaaaattaccataaaagtagaaagtatttcttcttgaataacaattattgatatatgtctgtttctccacagagtgatgacagacctaatgctctattaagttcacctgcaacagaaacaggtaatagacacaaaggtgcaattaaccacatcaagattataattctttatttttttatttaaaaaataataataaatagagacgaggcctttctgtgttgaccagggtggtctcaaactcctgggctcaagggatcctcctgccttgttctcccaaagtggtgggattacagatgtaagccacagcacccggctaagattataattttttaccaagattttcctaaattacttgttagagagctgtggctgctttttctgagatagaaatcagatacagaattggaaaccactgggtttttttttttttttcccatttttaaattaaattggttgctcagctagtcagccatttgatatgaataagtgaacaacagccgtaggtctgcgggagactgttcaatatgataacattcattctgcctttattgataacaccaaaaataacatgacaatgtaaaatacatacaagcggtcctcctggtttcatgattattttctgtaccagacttttcatcattaaatagaattattttatatcattgccatgtttattttttacttgttacttttgtaacttgtatgtctgctattatattttcatctcctttaatctcattttatttttcatgctaatttagttcatcattcccctgcatattcttttcctgctgctatccagagaaatcagcctcagcgccctgaaagcttccttttccgagcaggtgtcagggcagaaaccaacaaaggtaggtggtggtgattttaaaagccaggagcgaggggaggtttacacaacgacgctagctgttagatggatgcttttaaacttctgcatatagtataagacaaagctatcagctcggcaaaagcatgtgtctgtgatctcactgatactaaagcaggaaaatcttatctgaatttgtttggatgagaaagtttcttagtgccacctaaaagcaggttatagagtgtttgaacaaataaaatgcgctttcgaggctttagagaatgttctttgtcttggtaatgaactctttttcacatttttctattgataaaagctgttttcttaaaacaataattgttttaaaatctactttaagtctcatgttcttttagttaataatgacaaatttctccctggtccccaaagaagttacctgggagtggaaacaaacatttcaagtcaaaaataacaacttttatcatggtggtgtgtgcctgtggtcccagctacttgggaagctggcggggaggattgcttgagcccaggacttcagggttacaatgagttataattaaaagcaccactgttctccagcttggccaacagagcaagactctgtctcttaaaacaaacaaacaaacaaacaaacaaaaataaggtcaggcgtggtggctcacgcctgtgatcccagtgctttgggaggccaaggcaggcagatcacttgaggtcgggagtttgagatcagcctggctaacgtggtgaaaccctgtctctattaaaaatacaaaaaatggctgggcacggtggctcacacttgtaatcccagcactttgggaggccaaggcgagcagatcacgtcatttgaggagttcatgaccagcctggccaacatggcgaaaccccgtctctactgaaaaaatacaaaaattagccgggtgtggcagcaggcgcctgtaattcctgctactcaggaggctgaggcaggagaattgcttgaacttgggaggcagaagttgcagtgagccaagatggcgccactatactccagtctgggcggtagagtaacaaactggccaggcatggtggcaggcgcctgtaatcccagctactcgggaggctgaggcagagtcgcttgaacccaggaggtggaggctgtagtgagctgagattgcgccactgcactccagcatggatgacagtgtgaaacttatgtctcaaaaaaaattaaaaaataggccaggcgtggtggcacgtgcctgtaatcctcgcactttgggaggccgaggtagatgggatcacttgagctcaggagttcgagaccatcctgtgcaacatggcaaaaccccatctcttaaaaaaatacaaaaaattggctgggtgcggtggctcacacttgtaatcccagcactttgggaggctgaggcgggcagatcacgaggtcaggagatcgagaccatcctggctaacacggtgaaaccccatctctactaaaaatacaaaaaaaattagccaggcatggtggcaggtgcctgtagtcccagctactcgggaggctgaggcaggagaatggtgtgaacccgggaggcagagcttgcagtgagccgagatcgcaccaccgcactccagcctgggtgacagagcgagactccgtttcaaaaacaaaaacaaacaaacaaaaaaaggcatggtggtgcaggcctgtagtcacagctacttgtggggctgaggcgggaggatggattgagcccaggaggttgaggctgaagtgagtcaagattgcgcgattgcactccagcttgggtaacaaagtgaaaccctgtctcaaaaaaacaaaaaaaacacaacttaccttcaatgttaccaacagatgcattcacagtaagatttaaaagtcaaactacagatgcactgctggtgagagtgtaagaaagcatggaagactgttatcagtcagcctctgtacccacagattctgtatttatggattcaaccagtcatggacagaaaaatcttcagaaacaagacaacgataataaacaatgccacaataaagaaataatactaattttgaaatacagtatagtaacaatttatatagcatttacattgtattaagtattgtaagtaacagagatgatttaaagtatagtataaaggaggatatgcatagtttgtatgcaaataatactacattttatatgagtgacttgagcgtccacaaagtttggtatgagagaggtggtttctggaactaatttcccctggatactgacggatgactgtgtaccctatgaccagcagttttacttttgagaaatatgtacacacgtgtaccaacaacgtgtacaaaaatattcatagcagcattattcataatagcctgaaactgaatgtccatcaagagaatggataaatgaattgtggtatatttgtacaatggaataccatataagcaatgaaaatgaaccaattcctatatacagcaacatggataaatctcataaacttaccattgatcaaaggaagccagaagcaaaagaatacatacaatacagcataatttatacaaagttcaaaaatgaaccagaccagcctacagtgttagaagtcagggtgcggttttgagcacgttgggtacttatgggcaaggagcatggaaggggctcctgggattggtaagattgcattaaaaacctgattgtgttcacttggtgaggagaattttttgagcactgtgcttacgatttgtgtatttttctgtgtattaattttcaataaaaacatttttaagtggatgtaatcaaacaaaagtagttgagtcaactgggtaatgaacattacatatttttctatactattctctgttgtgtatatttgaaaatctccataataaaaacccttttaaaaagtcaatccagaaagtggaaagcaatatactgtacttgcaggaagtagaaaccaatatactgtacttgcaggaagtagaaagcgatgcactgtacctgcaggaagtagaaagcgatgcactgtacctgcaggaagtagaaagcgatacactgtacctgcaggaggtagaaagcgatgcactgtacctgcaggaggtagaaagccatgcactgtacctgcaggaagtagaaagcggtgcactgtacctgcaggaagtagaaagcggtgcactgtacctgcaggaagtagaaagcggtgcactgtacctgcaggaggtagaaagccgtgcactgtacctgcaggaggtagaaagcggtgcactgtacctgcaggaagtagaaagcggtgcactgtacctgcaggaggtagaaagccgtgcactgtacctgcaggaggtagaaagcgatgcactgtacctgcaggaggtagaaagcgatgcactgtacctgcaggaagtagaaagcgatacactgtacctgcaggaggtagaaagccatgcagtgtacctgcaggaggtagaaagccatgcagtgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatgcactgtacctgcaggaggtagaaagcgatacactgtacctgcaggaggtagaaagccatgcagtgtacctgcaggaggtagaaagccatgcactgtacctgcaggaggtagaaagcgatgcactgtacccgcaggaggtagaaagcgatgcactgtacccgcaggaggtagaaagccatgcactgtacctgcaggaggtagaaagcgatgcactgtacctgcaggaggtagaaagccatgcactgcacttgcagggaaactgtgatgaggcagagccggatgttctcctagcactgccagttgcctttctgtcttacatattaatatttttataggtcatgcttcaccccttcctccatctgctgcacctaccactgattctacagattccataacaggacagaattcaagacagagagaagaagagctggaattaatagaccaactgcgtaaagtatgtacattacctttgatttacactttttcagtattactgctatagatcataatcctgtgatcacgtcttcatttgacacatcatttttatttattttttttttagacggagtctcactctgtcacccaggctggagttcagtggcatgatcctggctcactgcagcctatgcctcgtgggttcaagcaattcttctgcctcagcctcctgagtcgctgggattacaggcgcccatcactgcacccagctagtttttgtatttttagtagagaaggagtttcaccatgttggccgggctggtctcgaactcctgacctcaggtgatccactggcctcgacctcccacagtgctgggatggcaggcgtgagcttccgcgcccggctgtaatttttaacagattagtgctgggattgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggccacttaactccacctggagagttcagggaagccttcccagaacgggcaaaatttgaactaattcttgaagtttaagaaggaattttccagcagtacagagaggggagggggccttccaggcataggatttctagattcagaagctaaggaaagtttggcttttacttaaggaattggtaaattgttcagaatggatcgtgcacagggttgtaatacaaatggtaaggggtaaggctagagacgtgagctggggccgtggtacaaaggccttatgaaccgtgtgaaggacgtttaccctagtacagacaatgaggatacactgaattaaagagggaataccatgattctaactgcagtttagaatgacgaatctaggctgggcgcggtggctcatgcttataatctttgcaatttgggaggccgaggcagacgattgcttgagcccaggagtttgagaccagccaggacaatatggcaaaaccccgtctctaccaaaaatacaaaaatcagctgggtatggtggcatgtgcctatagtcccagctactcaggaggctgatgtgggaggatcacttgagcccaggagttcgaggctgcagtgagccgtgattgtgccagtgcactccagcctaggtgagagagcaagaccctgtctcaaagaaaaaaaaaaaaaaaaaaaaggaatgatgaatctaggtgctaagtgagaaatggaaaaattaaaggtggtacactacaaagatgcccaagccaggctcagtggcttgtgcctgtagtcccagctacttgggagcctgaggcatgaggatcctatgagcccaggagtttgagaccagcttgggtgatcttgtttcttaaaagaaaaaggaaaagagactgggtgcactggcttacgcctataatcccagcgttttgggagcccgaggctggtggatcacctgaggtcaggagttcgagaccagcctggccaacatggtgaaaccccaactctactaaaaatacaaaattagccaggagtggttcatacatctgtaatcccagctacttgggaggctgagccaggagaatcacttgaacccaggaggcggagcttgcagtgagctgagatcgcaccactgcactccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgtttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgagaccatcctggccaacatgatgaaaccccatctctactaaaaatacaaaaattagctgtgcatggtggtgcacacctgtagtcccagctacttgggaggcagaagcaggagaatcacttgagtccaagagacggaggttgcagtgagccaagatagcaccaccacactccagcctggcgacagagtgagactctgtctcaaaagaaaaaaaaaaaaaaaaaagactgaaaggaaatgaatcaagtgttgtagttacatttaaatgatgaactatgggtaattaatttttttggctgttcctccaagttttctttagtgcaggggtccccaacccctgggccacaaatgggtaccagtctgtggcctgttaggaactgggctgcacagcaggaggtgaacaggccagtgagcaaagcttcatctgtatttacagccactccccattactcacatcaccacccgagctctgcctcctgtcagatcagcaacagtattagatcctcagaggagcatgaacgctggtgtgaactgcgcatgcgaggaagggatctaggccacgggctccttatgagaatctaatgcctgatgatctgtcagtgtctcccatcatccccagatgggactgtctagttgcaggtaaacaagctcagggctcccactgactctacattacggtagatttcattatgtatgattatttcattatatattacaatgtaataatagaaataaaatacacaataaatgtaatgtgcctgaatcagcctgaaaccatcccccccagctccagccctgtccatggaaaaattgtcttctgtgaaaccagtccctggtgccaaaaaggttgaggactgctgccttagtgttacactgttttaaaatggaaaaaaaaagtttgtaactattcgttcaaagtttttctatttagtacttgccttccaaaatcaaagccaatgtctcaagtgtggggtgacaaagtactgcccacaggccagcacttcttcttgtaaatcaagtttcactggaacccagtcacactttcttgtttgcatattgtctatagttgctttcaagctcctggcagactcgagtggttgcaacagttctttttttttttttgaaatggagctttgttcttgttgcccaggcaggagtgcaatggtgcgatctcagctccccacaacctctgcctcccgggttcccgggttcaagtgattctcgtgcctcagcctcccgagtagctgggattacaggtgcccgccaccacacctggctaatttttgtattattagtagagacggggtttctccatgttcgtcaggctggtctcgaactcccgacctgaggtgatccgcccacctcagcctcccaaagtgctgggattatggcgtgagccaccgcacctggcattgcaacagttcttatggccctcagaactaacatttattatctgatcctttaaaaaaaagttcgctgaccccctagtctacagcattgagagttatgaagcgattgccaggagtatttctaaagttagcaaatattttttaatgttgctagtaggctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcctgctatgaggatttattgcctccagctcagttataactttattgccctttaatattacaaatagttaaatttatttatagatgcgattaagggaaatgaacttgatacagtcttatccaataacccctttaaaaagcaattatattaaaccaactaagtattatactattaaggaatattatgtggtataaagacaaatttaaagaaataaatgacttggtgccatgtgatactttttcattaaccacgaccattacaagtcttgttaacatattttgtctatagcctgcaaggaggaaaacatgattcttctctatcaccttctaattaggtatcagtaactcaggggtggccctggggctcatcaacagctccaccattgctctcagagtttggttcctgttcctgtagcttccatgacagtgattctctttacccaactcaccgcacccatggcagtgattctctttacccaactcaccgcacccatgacagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccagttcaccgcacccatggcagtgattctctttacccaactcaccgcacccatggcagtgattctctttacccaactcaccgcacccatggcagtgattctctttacccaactcaccgcacccatggcagtgattctctttacccaactcaccgcacccatgacagtgattctctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtcaagtccattcttgtatttatttaatgaattttgcaatctgtaaaatggagggtttggatgatctctgaggcccttaacagctctgccttcattttgaacacattctcgagctggacttggttaaaatagacaccccctggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggcgggcgcctgtagtcccagctgctcgggaggctgaggcgggagaatggcgggaacccgggaggcggagcttgcagtgagccgagatcagcgagactccgtctcaaaaaaaataaaaaataaaaaaataaaataaaacagacaccctctgatttttagaggaatgccaagtcattgaatgcatttggcttctgggtagtaaattacccccggatcatgaggctttcctcagtctttgaacctttttgatgtacatggctttctccaaaaacgtccgtctcctcagcctctgcagttttcgtccttgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaacactccataaagtggggattggtggctctagtgtttcacttgtcaaaaatatctccaaactagccttccagagaacctgtgtccccatctttatagtttgtaaagttgtatatcctaacatcctatttctagcttgtatttataatttgtatccctgtttcctagaaaagttgctgaagcagcttacaactggatatgtattccatgccattttcacctgaataaaaacaccaaagtgacgataaatctaaaaggcaggcaggaaccaacatttattaaaactttgctgtgtatatattatgctggacagctaataacatcatattgtaattcctactgaatacttttgctcataagagttttttcactacagacaaattgggtaaaatcaaaatctgacattacaggaattactcaagtttcaatgcgtcactgtagctaagccagtgaactcctttgttctgctgagaaagagcaagaagaatgaatcttcacaggactactagaaacttcttcccagcaaggtatgaggaagccctaagtcaatggtgtaatcctaaatcagggtttgaaaacccacctaacaggcagagtgaaattaacaggcaaagtgaaatcaggcttccctgggaaagtctcaataggaaacaacctgtagatgagtcatctttgaggtaccaggtgtttcttaactctctccaagtccttcccacctccagaataccagcagaaaacacaaaagagaacttggtcacttcttcttgcctctcctcttatccttgcctttacctttgccttttgaatccttgctatcaactttgtctttaggcatcttgaaaccaccaatttctctccgtatcatagtgcctcgccaccaggcctggagctggaagagaaaaggggagtgagtacgacgtatgctatgcctgacaagctgcattctttccacataaagggactgttgaataaagtaacttctgtctgacaaacagtctctctccaggacatggaagtagccaggcacgtaatcacttcagcgatgctctcctgtcgtgcaggacccggagcttaagccatggactcaagagtgaagttctcaagtaaaaataaagaaaaggaatctgatttgacctattttttcttcacccgtagaaatctgacttccttatactgctttccttgaggaaagtccaggttccccatacttaacagctatttgaaccaaaaagaatgttagttacctgggccaagggcaaaagcactcggccaaaaatgcacagataatgccaggtgcggtggctcatgcctgtagtcccagcactttgggaggctgaggtgggcagatcactttgagctcaagggtttgagaccagcctgggcaacatggcaagaccctgtctctacaaaaatacaaaaaagaaaaaaaattagtcaggcctggtggcttgtgcctatagtcccagctgtttgggaggctgaggcaggaggatctcttgagcccgggaagcagaggttgcagtgagcagagattgcgccactgcactccagcctgagtgacaaagtgagatgctgtctcaaaaaaaaaaaaaagaaaagcacagataagtctagatgactttcataggcttgcttgtgcatttcatatctttagtgattgcttaaaagatcagttgtcctagtacttttaaaaaagatttagttagctttcttgaatatcttggttttagataacagttgttctcaatacggtctctactgctttaaagtcagactaaaccctaaagactggaagcaaatccactagtgaaaagaaagcaaacgtgctcttcagctcgttcttaacatgtttgttgtaaattcaggaatactgacaagttttatggggaaacaccattgaaacttgataaatacttgctacttacacatctgactccttatgggaagcccaactttgggtctggatacctggtccagaatgtggtataaaacttaactattttagatcaccctaatatacaacccaaactacagtgtacccactagggcctcgaccttcagagagaagggccagctccagacaggtgccgtccagctttcagtttttgcttgcgagtatttcacgtgatctgtgacctgccagtttcatcatcactgagacacacaagttcacataaaactaaaatatctctatttttttctaacttgctgcttatccttcccacctaagcagcttgtatcagaacccagcagatagtctgggctgatgtataagcaggattttaagaagtagaaggatattaaaaagaatcattctgtcaagagctggttttggttagacatagtaatctgatatttcgtctcttggcctaggttttgcttccgctgctaaccacctctttttccccagatgaagagctgggggcacgtccttttctatgttaactgtctccctgcaccatggactgttggcaaattctaataataacaaaagtccatgcttcttctcagatctgcagttccttgatatactgagatgtgtttgataatgaattggaaatgcttttgtgttcctcagtgttaagccagctgtggcgagatactgattatggttctttacctttataacgctctttaattccaagagatcctgttttaccttcttcttgctcctctccttttctatacgatcttcaatgatgacctgttcatactctcttatctgcaaagatagacattcatcatttattatagtactctcttggctaagctgtagcccagccagccctgcacttttaatataaaatttcaaaataaaacatgctcaatctaaagataaaccaaagaaaaaaatgtaatagattcctagatggtaaatattcacatattaactttataattgttcccaaaactttttcagttttaataattcaaatttaaattctatcttttataaaaaatgaaatatgaattaatgtgtgatcaatgatctcaaaataatatggattgttttttaaactttgggagaatgtacatacacaagtagtcagctgtcttttttgtttgtttgtttgttttgagacagagtctcactctgtctgtcacccaggctggagtgcagtggcgcagtgttggctcactgcaacctccgccttctgggttcaagtgattcttgtgcctcagcctcctgaatagctggaattacagccacgtgccaccatgcatggctaatttttgtatttttagtagagatagggttttgccatgttacccaggctggtctcaaactcctgatctctactgatctgctcgcctcggcctcccaaagtgctgggattataggcgttagccaccatgcccagcagtagctgacttttgaaagaaatttaggaagttctgcatttattccataatgaaaccataatcacaagcttgttagaaatcatcactgactctctccagaggtcataaactaagaataatcacagtatctgtctcaaggggctgtgtgggtagcaccttggacagagtaggcactacgtaagttagctactgcagctgtccccgtcagcagcagcagcatctaaaaagaatcctggtggcttataagcgcacctctacttttgaccccaaatagcaatacccagctactgtggcctatttgccactccttcctcggtgagcaccctgattccttccactccctcctcagtgagtgccctaattccttccactccctcctcagtgagcaccctaattcctttcactctgtcctcagtgagcgccctaattccttccttaccatctttgccaggtcttgaaggtgtgctaagtcactggcctttgtggctttgagagcatttagttcattctgtttcatttctgtgtccttatcgtatttctccatccagaactccagcctctcctcaagtttctatttggaaagaacatgaaaacatggcattcagcagacacaaaacgctgtatactgtatgattccacttatacgagtttcaagattaagcagaacattccatagtgagagaaggcagaacagtagttacttacctgggtggagagttggatttctgattgggaatgggggtgagggggactttgggatgctgtaaatgttctctgtatctttatccaggtggtggttacatgaatgtgtatacataactgttcatcaaactatacactaagtacttacacattttacttgtatgttagtgaattttaaaatagggggccaggcgcggtggctcacgcctgtaatcccagcactttgggaggctgaagtgggcggatcacctgtggtcaggagttcgagaccagtctgaccaacgtggagaagccccgtctctactaaaaatacaaaattagctgggcatggtggcgcatacctgtaatcccagctactagggaggctgaggcaggagaatcacttgaacccaggaggcggaggttgcggtaagcccagatcgcgccattgcactccagcctgggcaataatagcaaaactccgtctcaaaaaaaaaaaaaaaaaaaaaaatagggggaggagggtaatctagatgtctggataagggaagttgcaatgaagaggaaacaaaaggtatgtagaaaagtctgaaggataaggaatagcatcggatctctctttgattgacagcactaaatcctagtcaagaaggatacaatgtattcaaaattctaaaagaaaatgaatgtagggccgggcgcagtggctcacgtctggaatcccagcactttgggaggccgaggtgggcagatcacagagtcaggagatcgagaccatcctggctaacacggtgaaaccctgcctctactaaaactacaaaaaaaaaaaaaagccaggcatggtagccggcacctgtaatcccagctactcgggaggctgaggcaggagaatctcttgaacccgggagacagaggttgcggtgagccaagattgcgccacagcactctagcctgggtgacagagtgagactccgtctcaaaaaaaaagaaaaagaaagaaaagcaagtgaatgtgaatcaaagattctacacatagccaacccagcattcaaatgtaaaggaaagaaagactatactcaatatttctgagagagttattcaaggatgtactactgtagcaaaataaaatgaaagagatatattaagaaatggaagagaaccagtaaaacatgtatttaagctatgtgatagtttttaatcataaatcataattcagaattaaaatcccaaagtaggcaggatagtctagttgaaagagcacaactctggcactgaaagaaagtttacttaaattctctaagcttctggttccctcatatataaaattctatacctagccaataatacagtattactattacagtcatagtacaaacctcagagggttgttgtgatgctgaaataatccttgtgaagtccacccacaatgcgcatatatatacataatatctgcatatatattatcactatatatatttacatataaagtgaatgacttcaacatgggatgaagagcgagagaagaggtaagtgaagtctctttgccttaataaaggcaaaagaaggtataaacattgactaactctcgacagagaaattctaaaagtataaaaatatatgttaacattttaagagttgtgctcacttcagtaacatatataccaaaattggaacaatacagagatgattagcatggctcctgcgcaagagtgacacacagattcgtgaagcattccatatttgtgtactttctagaaacaaaaaatttaaaggttacccctaaaagaacagaaatgtgtaactttcagactcggggacgatgcacctcaagagtgaaacattgagaagttccttaggtggcacatagcatagaattttttaaaaacatggctatagtcaatcattgcgattacactgagcggggtggcttgtgcctgtaatcccagcagtttggaaggcagaggtgggaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaacaaaaaaaacaaagagggaacaggctccagacaggcaaaaaggtctggctacaaggtaataacatcatttggtattttttgcaattctatttacattattttatttatttatttactttgagataaggtctggatctgtcacccaggctggagtacaatggcacaatcttagttcactgcagcctccacctccagggctcaagtcatcctcccatctcagccttctcagcagctgggactacaggtgtgcaacaccatgtccggctactttcttgtattttttggtagtgatggggtctcattatgttgcccaggctgatctcaaactcccaagcgatccacccacttcagcctcccaaattgctgggattacaagtgtgaggcaccatgcccagcctatttatactaatttctatttatggaaggtgatactggtttttccttttatagtaatgatataaaaatcttaatttaaaatgaattgatttatctgtttaggtgagtatttaggtagaaaatattgaccgggtgccgtggctcacactataatcccagccagcactttgggaggccgagcaggtggattacttgagtccaggagtttgagatcagccttggcaacatggcaaaaccccatcgctacaaaacataggaaaattagccaggcacggtagcatgcatttgtagttccagctacttgggaggctgaggcaagaggatcacttgagcccaggatgcggaggttgcagtgaactgagattgcaccattgcactccagcctgggcaacagaacaagaccctgtctcaaaaaaaaaaaaaaaaaaattaagtaattactgcaactgggatgcattgtcagaaaaaaaatgaaaagttaaaaaaaaaaaaaaaaggctgggcgcagtggctcacacctgtaatgccagcactttgggaggccaaggcgggcagatcacctgaggttgggagtttgagaccagcctgaccaacatggagaaaccccgtctctactaaaatacaaaaaactagctgggcgtggcagcacatgcctataatcccagctactttggaggctgaggcaggagaaatgcttgaacccaggaggcggaggttgtggtgagccaagatcgcaccattgcactccagcctgggcaacaagagcaaaactccgttaaaaaaaaaaaattaataagtaacaggtggtatacagatattacaaaactatgagaatggcatgcaaataactagagtttggcaaaaaattgaacaacaaaaattctatcaatccaagaaaagaaggaaacaaaataaagtatataaattaattacaaacaaatgaaaaatcacaataaaagtaagctggggtaaatccttttgtcttagtccattccagctgctataacagaatgccagagactgggcggctcataaacaaattgatttgtcacagttctggaggctgggaagtcccaaatgaaggcactggcaaatcccgtgtctggtgagtgcctgcttcctagactgccatctctgtgctgtaacttcacttggcggaatgggaaagggatttctctgaggtctcttttttaagggcactaatcttattcattagagtttcaccctctatcaccttgggaatttggatttcaacatatggatttgggtgatgtaaaaattgagcccactgtactaccctctgaaagaaaaacttctttccccttcaaaaaaaatccagctatgaactacttagagaactacatgcccttgacatgtggggattattgcaattcaaggtgagatttgggtggggacactgaaccgaaccatgtcagatggtgtttttgtaaagatcaataaaatggtcaaacctttaataagtttcagtaagaaaaaaggaaagaagacacatctttttaaaaagttaatgaaaaatatttcattactacagaaataaaggactttttaaaattgtaaaaaaaaaactatacagtatagctttatgctaataaatttgaaatcagtgtttagatgaaatggattatcttctaggaagacgtaagttacaaaaaagactcaaaaagagataaaacaaccagagcaaaaggaaagcaggtttgacaattaatatctggcaaaatataaatcaatcaagccaaatataattaagagagacaagggatattttatactaataaaagacaaattctagatattacaattatgaaccgctatattctttttttggttctgtttatttatatttgcctcaggcccaagatagctgctgatggaacttttatgttgtaataacatattttagaatatatataaagcaaacattattagaaataatttctgtacaagatattaacagatccacaatcatcttaggaaactatcacacatctctgaaattaataggtcaggtaagccaaaataagtaacaaaatgaaaaatctgacagctagactaatagacatttataaaatattgtctgtaacagagattgcacactgtttcaagcacccatggaatatttacatagtctgaccataaccataaatccgaataagagcttgacaaattccaacaagcataaacctttttttttttttttttttgagacagagtctcgctctgtcgcccaggctggagtgcggtggcccaatctctgctcactgaagctccgcctcccgggttcatgccattctcctgcctcagcctcccgagtagctgggactacaggcacccgccaccacgcccagctaatttttttttttttttttgtatttttagtagagacgagctttcaccatattagccaggatggtctcgatctcctgacctcgtgatccacctgcctcggcctcccaaagtgctgggatcacaggcatgagccactgtgcccagccaagcataaatcttacatttcacattctgagaccacaatgcaagacagtaagaatagaacctccagtgacggggctgttgtgaggaataggaagcctacgctcttccctcacctcctccaagtacccagacatttaagaaacacccttttaaataattcttgagttacaaaggaaataacaaattataaactaaaaatcatttggaaaggaatgacaatgtaagcattatatatcagatcctgtaaattacagccaaatagtactcagaaaatatattggtttacatgcatttactagaaaataaaaaagtgaaaataaatgaattgaacatttaggaaactagacagattagcaacataaactcaaagaaagtgcaagaaaattactcaaaacaaaaaccagtgtggtagagaaaaagcagatttgctcaagaaaagcaaaagatggtgtattagtctgttctcatactgctgataaaggcatatcggagactgggtaatttataaaggaaagagctttaactgactcacagttcagcatgcctggagaggcctcaggaaacttacaatcatggcaggagagagaacgagtgccgagcgaaggaggaagccccttataaaaccatcagatcttgtgagaactcactcactatcacgagaacagcatgagggaaaccaacccatgattcaatgatctccacctggtctcgcccttgacatgtggggatcattacaattcaaggtgagatttgggtggggacacagaaccaaaccatatcagatggtgtttttgtaaagatcaataaaatggtcaaaccttcaacaagtttcagtaagaaaaaaggaaagaaggcacatctttttaaaaagttaatgaaaatgatttcattactacagaaataaaggactttttaaaattgtaaaaaaaactatagggcatagctttatgctaataaatttgaaatcagtgtttagatgaaacagattattttctagggagacgtaagttacaaaaaagactcataaagagataaaagatcaataatcctttttttacagttgaaaaggtagccaaatagctccaattaaatataaccagacaaaattgtttatgattgaattttatcaagcttcaaggaatagataatgttttcactgaagaaggcattagctaaaaaataaaatcataataataatctggtttgttttctgtttttatgtttcagagcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaaaaaagaaaaatgaaaatcagtagaaagaaaatgcagcagaggctgtgcagagtgagagggcgaaatagaagcctccactgatagttccccccaccacccagaaacactaaatttgacaactatctgtacaaaaaagcaccttcataagaaccaaaaatcaggtaagcaatcgcagtacctggttttaacttcgttttgctgaaagaggcactgaagagggtaggaaagacggctttgaattgctgacgacactctccaccccctggcagcagccacacggcacgggtaggatctgagcagctgtgggagggcgggcgcggcacctgagatgtgcattgaactcagtgctgccgtcacagtggaaaaagcaaaaccgggttgaactcgggtgacgcccacccatggagggagcactgagaccagccccagccagaggagaaccgcccagcctagcagtgggacccgagtcccagcaagcctcagcatctcgggctacgccgctctggggtcctcaatacacttgaaaggcggtctaggccaggaggactacgaccctctacaacccttacgcaagccctggtcctggtgcctgtggacttgggggacttggacctagtgagacaccagccatggtggttaagggagtgcttgtgtcacccatcccccaacctcaggcagtgcagcctctaaaagagatttccccttcttctgtttgaggagagggaagagtacagaggactttgtcttgcatcttggataccagctcagccacagcagaatagagcactgggcagaggacaccagctcagccacagcagaacaaggcactgggcagaggatagcagctcagccacagcagaacagggcactcagcagaggacaccagctcagccacagcagaacaaggctctgggcagaggataccagctcagccacagcagaacagggcactcggcagaggataccagctcagccacagtagaatagggcactgggcagaggataccagctcagccacagcagaacaaggctctgggcagaggataccagctcagccgcagtagaatagggcactgggcagaggataccagctcagccacagcagaatagggctctgggcagagtcatgaggcccccactccaggccttagctcctgggtggccttcctagacacaccttgggccagaagggaacccactgccttgtaggggagggcccagtcctggcaggattcatcatctactgacgaaagagcccccgggccctgaataaccagcaggggtccacaggggtacaccatgggccttgggtgagactcttgagatgtgctgccttcgaagacatggtagtggctatggtgagagactcctgcttgagaaaagcagaggaaaaagtaaaaggggactctgtcttacaccctaggtaccacctcaactataatggggtagagtaccaagaggctcttggagtccccagttcaggccttgactcttttttttgagatggagtctcactctgttacccaggctggagtgcagtggcacgatcttggctcactgcaacctccacctctggggttcaagcgagtctcctgcctcagcctccaagtagctggcattacaggcacttgccaccatgcccggctaatgtctgtatttttagtagagaccaggtttcaccatgttagccaggttggtctcaaactcacgaccccaggtgatccacccctctcagcctctcaaagcgctgggattataggcatgagccaccgcccccggcccaaggccttgactcttggatggcatttctggtcctgttctgggcaagagggtagcccactcccctgaagagtaagtcccaggcctggcagcattcaccacaaactgactggagagtccttgggccttagctgaacatcagcagtagcctggcggcactctccatgggcctgtggtagtagtggccatgagcagcggctcctccgcatgtggaaagcagatggaagaggaggaaggactttgtcttgtggcttgaaggccagcttagctgcaggagtttagagcataaggtagacttctaaggtttttgactccagctcttggctcccagacagcatctctggacccgcccagggcctggggggactggccactctgaagggaaggatacaagcctggctgatttcgccacctgctgattgtagagtcctagggccttgagtgaacataggtggtagccaggtagtggttacagccttgggtgagaccaggtgctgtgctggcttcaggtatgacctagcacagtcccagtggtggtggtcaccagggggcttgtgtcaccccattctcagctccaggtagctcagcaaagagttagagactctgggagaaagtaaggaaaaagaacaagagtctctccctggcaatccagaaaattcttctggatcttatttaagaccaccaaggtgatacctctacatgtctgcatgaaccacagaattaggggcttggagtgttccctaatgaggtacggcttagaccacaacactcaagtcccttcgtatgcctagaaagcctttgcaagaaggatgagtacaaataaacccagactgcaaggactacaatgaatacgtaattcgtcaatgcccatataccgatgaacatccagaagcatcaagaccattcaggaaaacatgacctcaccaaacaaatgaaataaagcaccagggactaatcgtggagaaacaaagatatgtgacgttttagacagagaattcaaaatagccattttgaggaaactcaaagaaattcaagataacacagagaaacaattcagaaatctatcagataaacttaacagagattgaaataattaaaaagaagcagaaactcttgagttgaaaaatgcaattgacatattgaagaaggcatcagagtctcaagagcagaagtgatcaagcagaagaaggacttcgtgagcctgaagacaggctatttgaaaatacacaggaaagacaaaagaaaaaaggataaaagaaatggaaagatattccatgttcatggattggaagaatcaatattgttaaaatgtacattactacccaaagcaatccacagattcaatgcactccctatcaaaataccaatgacattcttcacagcaatagaaaaacaatcctaaaatttatatggaaccacaaaagacccagaatagccaaagctatcctgagtaaaaataaactggaagaatcacattacctgatttgaaattatactatagagctatagtaaccaaaacagcatggtactggaataaaaacagacacatagaccaatggaacagaatagagaacccagaagcaaatcaataaatctacactgaattcatttttgacaaaggtaccaagaacaaacactggggaaaggatagtcctttcaatgaatggtgctgggaaaactgaatatccatatgcagaagaatgaaactagactagacagctatctctcaccatttacaaaaatcaaatcaaaattggttaaagagttaaacttaagacctcaaactatgaaactactaaaagaaaacactggggaaactctccaggacattggactgggcaaagatttcttgagtaataccccacaagcacgagcaaccaaagcaaaaatgaacaaatggatcatatcaagttaaaaagcttctgcacaggccaggtgtggtggctcacacctgtaatcccagcactatgggaggctgaggcaggtggatcacttgaggccaggacttcaaggccagaggtgaaaccccacctctactaaaaatacaaaaattagccgggcatggcagtgcactcctgtagtcccagctacttgggaggctgaggcacgagaatctcttgaacccaggaggcggaggtcgcagtgagccaagattgtgccactacactccagcttgggcgagagagcaagactctgtctcaataaataaatatataaaatataaaaggcttctgcatagcaaacaaaacaattaaagtgaaaagacaacccaaagaactggagaaaatatttgcaaactacctatatgacaagggtttaataaacagaatatatgaagagctcaaacaagtctataggaaaaaatctaataatgtgaaaaatgggccaaaagggccgagtgtagtcactcacacctataatcccagcactttgggaggcctaggctggaggaatgcttgagctcggagttcaaggcccgcctgggcaacaatagtgagatcttgtctctctctctctctatgtgtataacatatacatacatacatacacacacacatatatatatacatacatatatatatacatacatatatatatacatacatatatatacatacatatatatatatacatacatatatatatacatacatatatatatatatatatatatatttttttttttaaagggccaaagatctgaataggcatttctgaaaagaagacacacaaacaccaaacagacatatagaaaggtgctcagcatcacagatcatcggagaaatgcaaatcaaaactacgagacatcatctcgccccagttaaaatggtgtgtatctaaaagacaggcaataatgaatgctagcaaggctgtggagaaaaaggaatcctggtacggtattggttggtggaaatgtaaattagcacaaccactatggagaacagtttggaggatcttcaaaaaactaaaaatagagctaccatatgatccagcaattccactgctaggtatatacccaaaagaaaggaaattagatgtggaagagatgtctgcactcctatgtttattgcagcactgttcacaatagccaagatttggaagcaatgtaagtgtctaccaacagacgaacggataaagaaaaggtggggccgggcgtggtggctcatgcctgtaatcccagcactttgggaggccgaggcagatcacctgaggtcagaagtttgagaacagcctggccaatatggagaaaccccatctttactaaaatacaaaaattagctgggcgtggtggcgcacacctgtagtcccagctactcgggaggctgaggcaggagaattgcttgaacctgggaggcagagattgcagtgagccaagattgtgggcaacagagcaagactccctctcaaaaaggagtaaataaataaataaatttaaaaaggtgggacatataaacaatggcgtactattcggcccagaatgagattgtgtcatttgcaacaatatagatggaactgaggtcattatgttaagtgaaataaaccaggcaggggaagacaaacttcacatgttcttctttgtgagagctaaaaattaaaacaattgaactcatggaggtcgagagtagaagggtggttaccagaagctgggaaggtagtgggggatgcggagggtgtggggatggttaatgtgtacaaaaaagtagaaagaatgaataagacccagcatttggtagcaaaacagggcgaccatagtcaataatttaattgtaaatttaaaaagaaccaaacgcgtgtaatgagatcatttgtagcacaaaggataaaggctcaaggtgatggagaccccaattcccctgatgtgactcccacgtgtcacacgcctgtatcaaagtacgtcatgcactccataagtatatacacctactatgtgcccacaaaaattaaaaattagaaaaagaaaagagtttaaaatagaaacaattttaagtctataaatcagtttttcagcagtctattaaaggaataacaggccgggtgtgatggctcacacctgtaatctcagcacttcgggaggctgaggcgggtggatcacctgaggtcaggagtttgagaccagcctgaccaacataagaaaccctgtctccactaaaaaaaatacaaaattacccaggcatggtggcaggcgcctgtaatcccagctactcgggaggctgaggcaggagaatcacttgaactcgggaggcggaggctgcggtgagctgagatcgtgccactgggcaacaagaacaaaattccaatctcagaagaaaaaaaaaaggaataacacattatgatcgagtaaggtttatcccaagaatttgaagatgactcaacatcagcaagtctattaatgtatttccctttattaacatattaaagaagagaaaacaatatcatctcaattaatgaaaaaaaaatccatctcaaaattgagtactcatcctgatgagaagaaaaacttttaacaagaaaaaaagatacttcctgaagttgataaagcttgtctaccagaaacctacagagtaaatctcacagttgatgattaaaaaaaaaaaaactcatttgtggcagttaccaatttactgcctgtcagctccaaatccacctctttgctttgtgaaagtggatgcttgctgtgaacgtttttcttgccagctgacaaaatgctaagctgtgtcagtagagggcgctggaggcacacgacaggagggcgtctcactgtccggtcaccagagtgcggctgccagcggtatgtgggtgggacacccggccgcacttgtccacccacacgttttactgagaccgcgcaggaggattcctgctggccaaacacgttatgacctagtagggtttatcccaggaatttaaagatgactcaaatcagcaactctctcaatgtattctactttattaacatattaaaggagaaaaaataactcaatggacaaaaaaactgtttttcttttttttttttccctaattgagtacgcatccagattaggaaaacaaaacaaaacaacaaaaaaaacttttagtaaggtatctgtcacctaaccaccattaatctcccattttgactagtggccacgctgtcactttgggtccccgtgcatgaacatcaattcagagccaatgcttcagtcatctcagaaggcctgggtagtttgctttccccagtgcacagtcactctgtaaatagcacaggtcttctgagtagggcctagagggagacttacagtaggtacttgcagcagggctgcagagttcattctttgggggaaatccccccacaccctcacaccccagttcataaaggggccctggggctgtgaactgactcagtcctaagagctaggggagaggccgtgactctctgctgtggtgattcaaatcaggtttctggctaccagacccagaatttttttctgttatacttgagtaggcagcccaacaattttgttcctagagataccatcattcattagccattgccaagaatcccagtggccaaaggcattctgattacatctctgccgcccttcgtggtaaatgtgcccaccttatctctgacaattaagtgctcccaattatccggaggcacttcaggatcccatcaccccactgataccaggaagctcatctcaatgacaacatccttagggtcacacctgcctatgtaggaaagcaagcacagagcttttagagaggcagatgctcccctcactattctatttctcaatgtcttagtaaagaagtgtcttctgggccttctcatggttaggaatgggtgcttggtggtagacgtgtaagtcacacatgataaatccactgtgacattcctgtctccctacatctttggattctctcccccaaatcatagcagggaagctctgacatctccacctcatcaaatgtaggcaaatgttgagtcacctcctgctgctcaagctaaaccatgaaatccagactctctggtaagtgcatctatatcaatgaattaaacaaatggagtgtgatagcctaccctgttggatctaacactcttagaatcaactcgacatgtttcccaggtttcttccaatatttattagcaaaatcttaccattcttttggtgtgtaagtgatttccttctgagttagttatctgagttttatgtcccactgtaacatgctaagatttgaccctagttatggatccagtgacaacaggggtgactgtaccaggtctgaagagtgagccgtttccaaggcatcctcccagatgaagttatcacaggggtgactgtaccaggtctgaagagcaaccctttccaaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaaccctttcccaggcatcctcccagatgaagttatcacaggggtggtgactgtaccaggtgtgaagagcgagcaaccctttccaaggcatcctcccagatgaagttatcacaggggtgactgtaccaggtctgaacagtgagccctttccaaggcatcctcccagatgaagttatcacaggggtgactgtaccaggtctgaagagcgatccctttccaaggcaccctcccagatgaagttatcacaggggtgaatgtaccaggtctgaagagtgacccctttcccaggcatcctcccagatgaagttatcacaggggtgactgtaccaggtctgaagagcaaccctttccaaggcatcctcccagatgaagttatcacaggggtgactgtaccacgtctgaagagtgacccctttcccaggcatcctcccagatgaagttatcacaggggtgactgtaccaggtctgaagagcaaccctttccaaggcaccctcccagatgaagttatcacaggggtgactgtaccacgtctgaagagtgacccctttcccaggcatcctcccagatgaagttatcacaggggtgactgtaccaggtctgaagagcaagcaaccctttccaaggcaccctcccagatgaagttatcacaggggtggtgactgtaccaggtctgaagagcaaccctttccaaggcaccctcccagatgaagttatcacaggggtggtgactgtaccaggtctgaagagcgagcaaccctttcccaggcatcctcccagatgaagtcatcacaggggtggtgactgtaccaggtctgaagagtgacccctttcccaggcatcctcccagatgaagttatcacaggggtgactgtaccaggtctgaagagcaagcaaccctttccaaggcaccctcccagatgaagttatcacaggggtgactgtaccaggtctgaagagcgagcaaccctttccaaggcatcctcccagatgaagttatcacaggatcttcaggcaaaggaagtgcggtgtcctcagacacaggagggcagggtacttccgctgccaagggagctttaaagtgatttgccagtttcatccgaatctgagcaggtgttctcattccaagtttcagggtcctgttctttccctgtgagtgctctaacttgcatatcagtaacttggcatgactatgacaaactcatgtgtaatcctgactaaaacaccagaacagtggtgttgtattaacaaccaataatagaaaaaggattccccattgtcactactacaaccaacaagtacactggactttctagctagacaacaagccatgaaatgaaaacagacatataaataataaaaaggataatataaaattgttatttgcatgcagtaagattttccacctaggaaatccaaatgaatccactgaaaaaccattagagggtttaacaaatccacagcaatacacaaaagaaatacctttccacataccatacacttagagacagaaccaagaaggtttcgcaatgttatcacagaaaaacctggaaacaacctaaatctactgacagaatggttcactaaatttcagtatattctgagtgtgagatatattctatcaatcagctgtactgctacagaaaacattaaaaacaaagtaaatgtaagaagaaaacaacaggctctggaacactatatatagcatgatccaatttacttaagaaacaaatactaggccgggtgcagtggctcatgcctgtaatcccagcactttgggaggctgaggccagcagatcacttgagggcaggagttcaagaccagcctgaccaacatggtgaaaccccatctctaccaaaaatacaaaaattagccaggtgtggtggcaggtgcatgtaatcccagctactcgggaggctggcaggagaatcacttgaacctggaggcagaggttgcagtgagccgagatcgcgccattgcactccagcctgggcaacagagcaagactcctctcaaaaacaaaacaaaacaaaaaaccaccactgagaataggtatgtttttaggtataagtatgtatatgaaaagaaatacatgtggaagaaacttcccttcagaaaggggagtaatttaagagggctttcactttctttaacctatgtatttctgtctgaaattgtagctggacgtggtggtgcacacctgtagtcccagctactcaggaggctgaggtgggaggatcacttgggcccaggagtttgaggctgcagtgagctatggtggcaccactgcactgaagcctgggaaacagagagagaccctgtccctaaaaaataaaaaataaaaaaatatatacttatgtattgcttgtgttattgggctgaagatctgggaaactctggcgtcatcccttcgtgatccatttatctaccaactcactgataaatatccaacacctgccaggtatctcacacttgaaacaggtaacatgatacataattcttaaagtgcagggctacagaaccctaattctaatagcctaccaggtatttttttcagtaaagacctgcaagagagcatctacaaattctcctctttaaccacacatttggaatccttgactgaaaactcattagctttttccaaaggcaagctgtattataactaagctggaaaattttctctttattcatccaatagggttattttgaaagactccagctggggctgggcacggtggctcacgcctgtaatcccagcactttgggaggccgaggcaggtggattacctgaggtcaggagttctagaccagcctggtcaacacagtgaaaccccatctctactaaaaatacaaaaattagctggacgtgcgcctgtaatcccagctactcaggaggctgaggcaggcgaatcgcttgagcccaggaggccgaggttgcagtgagccaagatcacgccactgcactccagcctgggcagtaaagcaagactgcatctcaaaaacaaaacaaaaaaaaaaaaaaaaagaaagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaaaatattgaaaatggctactaatattgaagagaccttgaaattactgcctgcaacactgctaacggcagcacagattcgagagtattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgatctcggctcactgtaacctctgcctcctgggttcaagcgattctattgcctcagccttctgagtagctgggattacaggcgcccgccaccatgcctggctaatttttgtatttttagtagagacggggtttctccatgttggccaggctggtctcgaactcctgacctcaggtgatccgctggcctctgcctcccaaagtgctgggattacaggcgtgagccaccatgtccggcctttatttatttttcttttttatttattggccactatactattgggaaaaatttttaaatatagtcataatttaaaaataattaatttaaaaattatgtctttttttggtttttgtttttgagacggggtctcgctctgttgcctaggctggagtacggtggcgtgatctcagctcactgcatcctctgcctcccaggttcaagcaattctcccacctcagcctcctgaatagctgggattacaggcgcaccaccatgcccggctaatttttgtattttttaatagaaacagggtttcaccatattggtcaggctggtcccaaactcctgaactcaggtgatccaccctccccggcctcccaaagtgctgggatgacaggcgtgagccactgtgcccagcccataaatttgtaggtcataatttgacttaataaattttaagtcataaattaagtcataatttgaaaattatgagtatacagcaatatagaaatcgaaaaatttcttatgtaagctcaatgataaaagcagaaaacaaaattttacctgcactctctcaaattacagctatataagatatctattcagatgcataaccctgaaagaaaacatgagctaaagttcattaggctgaaagaatgatggttggttttccttcaaaatattctttttgtttcctcagtataagcagagtacaaaaaaaaagtcaaagcatagaaaagctgtggggacccacctgctgctcctttctaaggaacatttcaatctctgtatgagtccgggcctcttcttcggttttcatcctgagtttctgtaagaacaatcagataccagtacgtcttccccgcagggctgggaatcagaagttctcaagatgagagcagcagctcggtcggtagctgaggctccctttaccagctgggatcccgggctttcagttccctgcaactcctgttcaccaacactgcagagccacgtggcgcggcactgtgtggactgcgtgtgtccctaacgagacgagcacaatcccgtgagctgaacagaggtgcccactgaaggacagaaacggcgctccaagggcacaaggctgtggggcttaaaaagggggattccggagtgccaggaagagtgttgacgtggccttgagccacgtcagtctcagagcgaggagtcctcccacacacagattccacggcccaaggacgtttgttcctgcttccctcttcccatctgcctgctgctctttcttgttttcttttcttttttgtgagaagggagtctccctagttgaagtctgaagttgcccaggctggcttcaaactcaaggatcctcctgcctcactgcctcacctccgattagctgggactagtgcctggctttgcgtgtgtgcgtgcgtgcgtgcgtgcgtgtgtgcgtgcgtgcgtgtgtgccatttagcattcccctcaaagaagatctaccacttctttcttcctcctggcatttttcaccgtgacttctcatcctataaactcaggtttgaacgaagttcagcgctctcgatgctgtatttcttactggaggagtgaaaggtactggttagatgaaagaaacagcagcaaaatcctgccataactaagcacctcgttttgccctctccctataattagtcagaaaaatggtgattggtttgccaaaataagaagtgaccaaggagagaaagtgcagccaattttcaaagtcattatgaggcgggagatggaggctacagcccactggaatctctgcttgcgaacacgcatatcctcatttaggcttttattttcaacctcaagtggaggggctgttgccgatagagatggagggaaatctttgtctccctcctttgttagctgagaggggatcaggagtgacagctcaattgccatctcctgggttcttggctaatgtcccagggattacctcaatctcttccaccaagagttcctctgttctgttacactttttctgggtctgggcaatctgcagctcggtattggttttcatgtagcgattctccaagttggattttgccttcatctcttgcagttggtccttgaggttagcaatatactcattctgactctgtagtggaaagaccaggtttctaaattgaaaatacattctacctccattcagttcagtcagcggcttacggttcccttttatgcgtataaatcaataaggaactggaactatttttccgctgtcacacaatgggaaatttagccaacaatcatgaagtgtatagatgaaagtgagtaacacagcatttctaagaatcagggcgcatcagggctgtgagattagttcccaggcacattattgctgtactccgtatgtcccacacagctttctcattttggtaggaagaacactggtcaaaatgatcaaaagaactgacttcccacccaggcctccagctgtgtgaacttggccaagtcaaatctccaactttttactttctataaaacaaacacacaaacatacaaacacccaacctgcctgaagtatctcagagagtgattattaggtttccttgagaacacgtgtgaaaacgctttctttttgcaggtcaccaagtgcttggcaattgtgaggactcaatagtcattaagaaaaatatttattcagcaccaggcactgagctaggaaaattgtggagatctaaacagacatattcccttccctcatagagcttacagtctaatagaagagaggtggttaaaaagagacaaacacatgtgtaaacttccaaaaattgtgcaaaatgatagaaaaggaaggctcgagaggctgtgggaggaaataacaagggaggagtacattagactctggaaggtctgagaaggactctctcgggaaagcgatggctcattcgatacctgaaggacaggtaagcccaccacatgaaaaataggcttggccaggcacgggggctcacgcctgtaatcccagcactttgggaggctgaggcatggcgaccagctgaggtcagcagtttgagaccagcctggccaacatggtgaaaccccgtctctactaaaaatacgaaaaatagctgggagtggtggcgggcgcctgtaatcccagctactcgggaggctgaggcagaagaatcacttgaacccgggaggtggaggttgaagtgagctgagatcatgccactgcagtccagcctgggtgatagagcgagattctgtctcaaaaaaaaaaaaaaaaaagaaaagaaaaagaaaaaaaggaaagaaaaagaaaagaaaaatagggttaagggaactctaaaaaaaaaaaaaagaataagtatatgcccaaatcctgaagcaatcaagacctggatacattccaggaactgaaagaaagctccggaggctctagcctagtgagggttgaggggaggacaggatgaggttggaggtcggtaagggcaccacacaggaccccggagacccaactgagaaattcagattttattccaactgtcatgggaatccttggaaagcttttagtcagggaggtaacatttgtttgaaaagaactgtttgggcggaatcagtgtgtgagtaagtccacagggaggggacctgacggcacagcaaacaagcacacgactagcaacaaaagtgcttcaacccgagacctgctcctctagataccaaccgcctttcttctctttttacattttttttgagatggaggctcgctcttgttgcccaggctggagtgtagtggcatgatcttggcttactgcaagctccacctcccaggttcaagtgatcctcctgcctcagccttctgagtagctgggattacaggtgctcaccaccacacccagctaattttgtatttttagtagagatggggtttctctacattggtcaggatggtcttgatctcccgacctcaggtgatccacctgcctcggtctcccaaagtgctgggattacaggcgtgagccaccacgcctggcctccaattgcctttcgtcttaaccatgtaagtagggtagaattagttcttttgtattaaaaaaatttttttgtttagagacaggatctccctctgtcactcaggctggagtgtagtggctcgatcacagctcactataacctccaattcctgggctcaagccatcttcccaagtagctagtactacaggtgcatgtcaccatgcctggctaactttttaatatttttagagatgggggtctcactctgttgcccaggctggtctcaaactcttggcttcaagggatcctcctgccttggtctctcaaagtgctgggatcacagacatgagccactgcgcccggctttgttgttgttgttgttgttgttgtttttgagacggtcttgttctgtcactcaggctgaagtgcagtggcatgatcacggctcactgtaactttgacctcccaggctcaagaaatcctcctgcctcagcctacagagtagttgggactacaggtgcatgacatcacactcagctaattattattattattgtagaaacagagtctcactgtgttgcccaggctggcctcgaaaccctgggctcaaatgatcctcccacctcagcctcccaacatgctaggattacaggcaggagccactgctgcagccagcctcttttctttcttgagatagggtccaccgtgtcccccaggctgtagtgcagtgtcaccagcatagctcactgtagtcttgaactcctagactcaaggaatcccctctctccagcctcccaagtacctagggaattaattctaagtaaccattggaagaaaaaacaaagtggtaattggacaaatcctccgttaaggaaagcaagcataggcagcggtgtccaatcttttggcttccctgggccgcactggaagaagaattgtgttgggccacacacaaaatacaccaatgatgaactaaaaaaaaaaaaaaatcacacaaaaaaatctctcataatgttttaagaaagtttacgaatttgtgttgggccccagtcaaagccatcctgggccgcatgtggcctgcgggctacaggttggacaagcttgacttaaagtatcattaggccccaacctggtggggtggctcacgcctgtaattccaatgctttgggaaaccaaggcaggaggctcgcttgaacccaggagttcaagagcagcctgggcaacacagtgaaaacctgtctctacaaaaaaatttaaaaattagctgggcctggtggcatgcgcctgtagtcccagctactagggaggctgaagtggtagactcccttgagccccggaggccgaggctgcagtgagctatgctcatgccattgcactttagcctgggcaacagagcaagaccctgtctcaaaaaggtccctaagatgaatcagaacggaattcttcaagttattttgtctactagcttcttgatataactctgcagaatcattctaattgtatgacagttattccaactagatcggaatcattcctaagagacggagcatctctggcacagaatatgctataggccctttgaaaatatgtcttaatatttcatattctcttacaagttgtaggattgcaggcaaattactggacctcactaagcctattttctcatctgtaaaatcctgcccaggctggagtgcctggcacaacttatatgctcaataaatgttgatgaaatgaattttaagagatgtctgcttttggctcactgtttttcttccattctttctatacgcacttcccttctcccctgtcttccccatttctcttttctcttttttttttttgagacagagtctcgctgtgttgcccaggctggagtgcagtggtgcgatcttggctcactgcaacctctgcctcccgggttcaagcgattctcctgcctcagcctcccaagtagctgggattacaggcatgtgccaccatgcctggctaattttttaatttctttttagtagagatggggtttcaccatgttggccaggctggtctccagctcctgacctcaggggatctgcccgcctcagcctcccaaagtgctgggattacaggcatgagccaccatgcccagcccatttctcctccttcttcctcttccctcccttctatttccaaattgtatggcagtcagtgaatcttttttttttttttttgagacaagatctctctgttgcccaggctggagtgcaatggtgcgatcttggctcactgcaatctccgcctcccacctcaacctcccgagtagctgggcctacatgtacgtgctaccacgccaccacacccagctaattttttgctttttttttttttttttttttttttggtagagatggggttttgccatgttgcccaggctggtctcaaactcctggtctcaaacaatctacctgcctcggcctcccaatgtgctgggattacaggcatgagccactgtgcctggtataggtttgaatctttaggaagactagagttaaagcaaaaatgtgatggttttacttcttcatcaactggaatccttttacctatataatcccttagatttccttcaaggtccaccttatatatcactcaagtaaataaagccttttgcagaaaacctcagcccacattgataactgtagttttgtttctcacagaatctaaatagtgttagacagggatttattgaatagtgtccgtacatacaaaaatatacttttgaaaactcaagagcatgttctggtaatttttctttctcaaatggaatattaagacttcagagtaacagtctgaagatcagaaatgcagagttaaaagtctttagcttctgcccatggtaaacagaaggtactgcatcatggaagtgttttttattgttgttgttttagaccgagttttgctcttgtcgtccaggctggagtgcagtgatgcaatcttggctcattgcaacttcggtctcccaggttcaagcgattctcctgcctcggcctcccaagtagctgggattacaggcacctgccactacgctgggctaattttgtatttttagtagagacagggtttctccatgttagtcaggctggtctcaaactcctgacctcaggtgatccacctgcctcggcctcccaaagtgctgggattatagacatgagccaccatgcccggccaatgtaagtgtttataaggacgtacaacattggctgtgccaagccaaaggcatctggttttaatgccgttgccatgggcctctgagtaccctgagttccttcctggattggtattttgcacaaacattttaatggccctccacggtgaccgtgtggaaacacagagaaagatataaaatcctgacaggctatgatggtaaaaccaagatcgaggcatactaacaagcgagcggaagtgctattccgtgtcctcttcttcccagtgtgtgagaacagccagcctagaagcagtggggtacaggctccttttcagagtttcactaagaaaagatttgccttcactacaacctcgaatccgagttgtccatggtgtcgggaaccttcctcgtggtcaggtccatggactgatgcatcacagttttgggttttcatggcagaccaaacattacttccaaatcccaaaattgccttcagatcgggacctctggacttgttattcgaattcagagaagcatgatttactaataaaaagaggcagtctaccaactcgagttaataaggctgtgatggctgccataataacgtgagccaagggctttaatggtagtgtctgctttcataactgtacataaagtacagaacggagtactggttcctggaagtttggaagctactatctgggaagttggcacttgtcttagacctcaggcttcccctctggttgggtagcaaaaggaaaatggtaatgttgtctattaaagagacaaaagccacaggaaaaaaatagttctctattaaattaacatttacagccaggctcggtggctcacgcctgtaaacccagcactttgggaggctgaggcgggtggatcacttgaggtcaagagttcgagaccagcctggctaacatggtgaaaccccatctctactaaaaaaaaaaaaaatacaaaaattagccaagtgtggtggcgtgcacctgtaatctcagctacttgggagggtgaggcaggagaatcacttgaacctgggaggcagaggttgtagtgagctgagatcgcggcactgcactccagcctaggagacagagtgagatcacatctcaaaaataaaataaaataaaataaattaacatttctatttgctgtctatgacttagaataccggctgatactatacgagtccatagactcagaataaactctgagctccagtaatcctagttacttgggaagctgaggtaggactagttacttgggaagcttgaggccaggagttcaaaacaagcctgggcaacaaagagagaacccccccatctcaattaaaaaaaaaaaaaaaaaggccagtcgtgatggctcatgcctgtaatcccagcagtttgggagactgaggcaggtggatcacctgaggccaggagtttgcggccagcctggacaacatggcaaaactccgtctctactaaaaacacaaacataagctgggcctggtggcatgtgttttactattgtttttgttgctgctgttagagtcaatgctaggcattgatagttttgatgctattgtaaataatatatataaattttcaattttctattctaaatctgttgctgatgtataaaagatagatttttatatatgaatcttggttctttttttcccaggagtttcatggaagtgctgatccattgttatcttgctttggatgttgatgttcagaagtctgaaactttttttgctttgtgactctttctttttgctgagtatctaaggcaattaatcctacacatctaagctaccaccaacactttcatatacaaaaacctgccattcttgttggcatcattttctgacccacagttccctaatgtgcatatacttcctatcttcttgttttccaaccttgacctgactactggttttcagtaactccggggatttaacctgatttcatcttggtcgacccgactactggttttcagtaactccggggatttcacctgatttcatcttggtcgacccgactactggttttcagtaactccggggatgtaacctgatttcatcttggtcgacccgactactggttttcagtaactccggggatgtaacctgatttcgtcttggtcgacccgactactggttttcagtaactccggggatttaacctgatttcgtcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcttcttggtcgacccgactactggttttcagtaactccggggatttaacttggtttcgtcttggtcgacccgactactagttttcagtaactctgcggatttaacctggtttcatcttggtcgacccgactactggttttcagtaactctggggatttcacctggtttcatcttggtcgacccgactactggttttcagtaactctggggatttcacctggtttcatcttggtcgacccgactactggttttcagtaactctggggatttaacctggtttcatcttggtcgacccgactactggttttcagtaactctggggatttcacctgatttcatcttgattgacccgactactggttttcagtaactctggggatttcacctgatttcatcttggttgacccgactactggttttcagtaactctggggatttcacctggtttcatcttggttgacctgactactggttttcagtaactctggcgatttaacttggtttcatcttggtcgacccgactactggttttcagtaactctggggatttcacctggtttcatcttggtagttcttttttgttccaaggcttgccttggatcttctagtcttggtttctttctttctttttttaagacccactacgaagcagaatcttggtttcttaacctattttttttgctgatgatcacaatatctgaatgatattctactttaattttactttggctgaatgtaatggctgagaatataattaagaggatacatctcaggagcaagtgttgttgctgttaggaaaattctaccatcaacaggtgtggtccttatggtagaatgggagttaactggcaaagtgctaaatctgaggtttcttttgacattgctttggagggcttaaaaggagactaatataaatatcttctggccaggcacagtggctcacatctgtaatctcagcactttgggaggccgaggcgggtggatcacctgaggtcagaagttcaagaccagcctggccaatatggtgaaaccccatctctactaaaaacacataaattagccaggtgtggtggcctacacctgtaatcccagctacttgggaggctgaagcaggagaatcgcttgaactcgagagacggaggtcgcagtgagccaagatcgagctgctgcactccagcctgggcgacagagctagactccatctcaaaaataaaaataaataaataaataaataaataaataaatatcttctattttaaaacatacttaaaagatacttatcttctataagataatgtcaaaagattcatgacttttaaaatagaagatatttatattagtctttttaaattatgagagtttttcagggaaaagagttaggaaacctctgaaaaagtctattcattacagagaaaacttaaacacaaactagttttcatgaagtttcccagagaagaaaagtagtttttaaaaaatataagctacatgcagagggttaagagggataatgacatcaagacctagagctacctaaggtgctttgtaattggcaaatacaaaataagagaaggtgttaggcaatttgcttggaagacttacagataatatcttaaaaaaaagtctagtgactttgtttttgagacggtctcactctgttgcccaggctgcagtgcagtggggagaccacagctcactgcagcctcaacctcctaggctcacgcagtcctcctaccttagcctcccacgcagttaggactacagatgtgtactaccacatccagataatttttttacttttccagttatttttataagttatttatttatagagacagagtcttgctatgttgcccaagctggtcttaaaccccaggcctcaaatgatccttccacctcctagtgaccttttaaaaacaattcttccatataaacttacaatattctcaggcccagtgcagtggttcacacctatcatcctagcgttatgggggggccaaggcagacagatcacttgagctcaggagttcgagatcagcctggacaacatagtgaaaccctgtctgtatcaaaaatttaagaaattatctgggtgtggtggcaggtgcctgtagtcccagctatctgggggctgaggcaggagaatcatttgagcctgggaggcagaggttgcagtgagctgagatcactccactgcactccagcctaggtgacaaagtgagaccgtgtctcaaaaacaaaacaaaacaaaaaacagtaaaaaataaataaataaaaatattctctcagctgggcatggcagctcatgcctgtaatcccaatgctttgagaggccaaggagggagaaacactcgaggccaggaggctgagaccagcctggacaacaaagcaagaccccacctctacgaacaattaaaccgcagcctggcgtggtggcacgtgcctgtagtcccagctactcaggaggctgaggtgggagaattgcttgagcgcaggattgcaatgaactataattgtgccattgcactccagcctgagtgacagagtgaagatcctgtgtctacaacaaataaataggctgggcacggtggctcacacctgtaatctcaacattttgggaggacgagatgggcagatcacctgaggtcaggagtttgagaccagcctggtcaacatggtgaaaccccgtctgtactaaaaatattttaaaaattagctgggcatggtggtgcatgcctgtagtcccagctactcgggaggctgaggcaggagaatcgcttaaacccaggaggcagaggtttcagtgagccgaaattgtgccattgcactccagcctgggtgatggagtggacagggtgagactccatctcactccaccaaaaaataaaaataaaaatgaaatatataaataaaatagttttccaacgtctatgtagggaataacgaaaattcccttctgtgaagcataaacttgtccaaacagctggtcagtgaaaagctgataacgggccatcctctgtaactttctcttttctttttttgagacggagtctcgctctgtcaccaggctggagtgcagtggcactgtcttggctcactgcaacctccgcctcccaggttcaagcgattctcctgcctcagcctcctgaatagctgggactacaggtgcgcaccaccacacccggctaatttttgtattttgagtagaaacggggtttcagcatgttggccaggatggtctcgatctcttaacctcgtgatccgcccgtcttggcttcccaaagtgctgggattataggcgtgagccaccgcgcccggccatcctctgtaactttctaaactgctcctagaaaagttgtcagtcatcctaatacagctggtttctaactgcttaggttgtagccccaactttgttttgcaagtcaattccttaaaacttgggatgcattttcttataaaagtaaactagatacgaggttaggtcctaatgaccacaaaagctcgcaaatccactttgtcctcaaaatacaatacaaataacataatgaagcccaaccactatgtatgagaaggttcataatgtgctgaatgtcttctttaggaatatacttttccatctgggatgtgagagtacaagagactgcctgagacaaggccccctgtgggggagggtgggggtgtatgtggggtgggatatgacgatgggatgaggtcatctgtgggggagggtggtggtgtatgtggggtgggatatgaggatgggatgaggtcatctgtgggggagggtgggggtgtatgtggggtgggatatgaggatgggacgaggtcatctgtgggggagggtgggggtgtttgtgaggtgggatatgaggatgggacgaggtcatctgtgggggagggtgggggtgtttgtggggtgggatatgaggatgggatgaggtcatctgtgggggagggtgggggtgtatgtggtgggatacgaagatgggaactaagggctccagggggttggggtctcgcagggctctatattccagacacacctgtacgacccaggccagctctctacttgctatctttatatcttctgtttttttttttttttttctgagacggaatctcgctctgtcacccaggctggagttcaatggtgcaatcttgactcactgtaacctcccagggttcaagtgagtctcctgcctcagcctcccaagtagctgggattacgggcacctgccaccatacccggctaatttttgtatttttagtagagatggggtttcaccatgttggccaggctggtctcaaattcctgacttcaggagatccgcccgcctcagcctcccaaagtgctgggactacaggcgtgagccaccgtgcccggctatgttttcaatagtaaaggaatgccggaggaaacaacaatcttttacatgtaactcttctctgcttgagaaagatggcttccatatatttaatagctgtgttagctcggtcacttttggtgttaagcaggtaattcttacctggacttcaaattgccattcctttttgacattaattagctgtttttgaagtgatattatctgttttcttcctttttcctccctagaagatataagaatgatttgtgtttagagcagtgcttctcaaaacttacgtgcacaaggaccaccccgcacataagaaaaccagattcctggcctcttcccccagagaatctgactcagcaggtctgggaggggcctgaagtgtgcatctctatcgagttcccaagcaatgctaacagggctggtccacgtcacattttcaataacacgttttaaaagacagatttgttttaatagattggaggaagattctctggcttgtcagtgtcgaatctaaaaatagctgctgctgagaaaaagtgaagaagagaaggacagcaagaggagaaagaagaatcctttctactttgggcacttcaattacatattctaaccctcacaatagcctgatttctattttaccgatgagaaaatgcggtgtagacagctaaggtgagttgatgtgctggatgtgagaatgtgcctcaccgatctccaactacagggggcgtaagtcagcaagggtcccggcttctaggctctgcaatccttctctgtgtgttctgaggccacactgcccacagactgctcccatcccattattaagtgtggcaggaatcacatgggatgggcctttcctggggagtcagggcgtctctgatggttgactttggctcaaggactcttgatgaccttgccaaacacagccgtgtcttccagcctctccttcactgggggtcagccttgcactggttctgaaggttccctccccattttctctcacgcagatctttcccctgataaaatctttgcatgaataattccatctcagcatccatttttcagaagacctggactaacacacttgccatggtcacacaaacagtaaatggcagaaaggggttcaaactcaggactgtcggacaccggagcctgtgaacttaactactttgtatgactgtttctcaatctactctgagaaacagccttctgcttctctccagcaatcccattatttaggtttaaaacaaacaaaaaatagcaaaacaataccagaataaacaaaacaaaacaaaagaagacttctcactaaactgcagctaggtaaagatttttactcaagaatttctatttttatgtatttatttttctttttttgagacagagtctcactctgttctccaggctggagtgcagtggcacgatctcgactcattgcaacctccgcctcccgggttcaagcaattcttctgcctcggcctcctgagtagctgggattacaggcatgtgccaccacactggctaatttttgtatttttagtagagatgggtttttaccatgttggccaggctggtctcgaattcctgacgtcaggtgatccacccgccttggcctcccaaagtgctgggattacaggtgtgagccactgcacccagccaggaatttttagaaagcacatagttaattaactagaatcttgagattgtcattgccaaaacaaactatagattatgtacttcccactcatagatcacaaaaaatagataagaaagctacagaatgagtactttccgtctactattaattcaatatcccaaggaaaggtttattgaaacaaacaaatatcatttacatgagattataaaagtgcccattttacacatatacaccatggaatactatgcagccataaaaaaggatgagttcatgtcctttgcagggacgtggatgaagctggaaaccatcattctcagcaaactgtcacaaggacagaaaaccaaacaccgcatgttctcattcataggtgggagttgaacaatgagaacatatggacacagggaggggaacatcacacactggggcctgttgtggggtggggggctgggggagggagagcattaggagaaatacctaatgttgatgacaggctgatgggtgcagaaaaccaccatggcacatgtatacctatgtatcaaacctgcacgttttgcacacgtgccctagaacttaaagtatcaaatgcaaagaaagtatgaagagaaataaaaatcacccataatcccactatctggagttaactatcattgaaattttattatatttccttccagtcaatacacactataattttttcttacaaaactaagttatattatgggtattatttttatcctaactttttcacttgacataaccatgtgctctttctcattttatttagcaggtgaacacatgcatttatttctgttccctctttttttttttttttttgtttttttgaggcagagtcttgttgtgtcgcccagcctagagtgcagtggcgcaatctcggctcactgcaacctccacctctcgggttcaagcgattctcctgcctcagcttcctgagtagctggggactacaggtgcgcatcaccatgcctcgctaatttttgcatttttagtagaggtggggtgtcaccatgttggccaggctggtctcaaactcctgacctcaaatgatccatccacatcgtcttcccaaagtgctgggattacaggcgtgagccaccatgcctagccctctgttcactcttgaaacaatactaaaataacaggcaagaaataatgaaaggtgtaaacctataaacacaaagagattgggagaagaaatgatgcagctgacagacatcagcaaaattaaagaagatataaagcagacaagagaaaaatgagatctaaatgtgtacagaatgagaagctaagaagaagaaaacagaataaagctacaggccccccagaaaagctcagcacatgaaggcactacacatcttcgaaggcacaactgtgccacagggctaaatccaggtggagcgatcaaaagtctggcaaaggagcaggatgacctgattcccttccccagccctgtggccaggcagctgccttttctcctctcgggagatcatgggtgtttggttagttttggccaggttgcctggaatggttgaaccaaggatttggacttgcagacggacaccagacacagctggaggtggagatgaaggaccatgctaaaaacagggggaccaaaaaacattctgcttaatggatggtgagtttccccagcctttccctggctagctctcaacacatgggtagtcagagaataaccactgacaataaccattacttcttcactgctcctcacccctcccagcaaagattggtagattcttcgagaatgctgactacaccaagggaaaagatgtacttttcttttctgcccagccatgctacagtgcagtgttgcccacatgcacagagcagagcatccatcagcttcttggcacttcactcttaaatacaaacggacagccaaagatgaccaaacacaattcccctaacattaaaaacagagactagagccaggtgcggtggctcacacctataagcccaacactttgggaggccaaggtggaaggatcacttgaggccaggagttggagactggcctgggcaacatagtgagacttcatctctaaaaaaacaaacaaaaaaaattagctgggcatagtggcaaatgtcttccagctactcaggaggctgaggcagaaggatagcatgagctcaggagttcgaggctgcagtgggctatgatcatgccactgcactccagcctgggtgacagagtaacatttgctctaaaaaatttagatgtaaattaaaaaacaaaacaaaacaaaacagaaaaacagaaggctgggcatggtggctcatgcctataaccccagcactttgggaggccgaggcaggcgaggcaggcggatgaactctagcatgggcaacaagagtgaaactctgtctcaaaaacaaaacaaaacaaaacagaaactaaaacaaatgggagaaaaagtaactcggagagaagaaagacaatacaagaaacagaagacaacttaaacaaaaaaagacaactataattaatgttcttagaaatatatgagaaggccaggcacggtggttcaaacctgtaatcctagcactttgggaggccaagacgggcagatcacttgagctcaggagttcgagaccagcctgggcaacatggcaaaaccccatctctacaaaaaaatacataaaattagctgggcatgcctgggtccccagcgacttgagggggctgaggcaggaggattgcttgagcccaggaagtcgaggctgccatgagccaagatcatgccactgcactctagcctgagtgacaaaaaagaatactataaaaaatgaaaaactcagggaagagctcttagaaatcaatgttagcataacattttgaaaaattaaacacaagggttagaagataaggccagttgtggttggggttacaggcgtgatcctagcactttgattacaggcatgatcccagcactttgggaggccgaggcgggtgggttgtttgagcccacgattttgagaccagcctggttaacatggtgagactctgactttacaaaaataaaacaattagccaggcatggtggcacacacctgtggtcccagctactcgggaggctactcacttgagcctgggacccaggatgaggctgcagtgagctgtggatcgtgccactgcactttggcccgggaggcagagcgagactcagtctcagaaaaaaaaaaaaaaaaagaaagaaaagaaaaggaagagcctgtgttcccagcactttgggaggccgaggtgggcggattacgaggtcaagagatcaagaccatcctggccaacgtggtgaaacactgtctctactaaaaatacaaaaattagccaggcgcagtggtgggtgcctgtaatcccagctactagggaggtggaggcaggagaatcacttgaacccgggaggcggaggttgcagtgagccaagattgtgccactgcactccagtctggtgacagagcgagactccatctcaaaaaaagaaaaaaaaaagaaaagaaaagaaagaaagagttggaagacaaagttaaggaaatctctctaagaatagaataaaaacaatgcagatggtaaatgagcaaaaaaggacaagaaaaatgcaggatcaatcattacaggatcaacatccaaagagagttccaggccgagcgcggtggctcatgcctgtaatcccagcactttgggaggctgagatgggtggaccacttgcagtcaggagattgagaccagcctggccaacatggtgaaaccccatctctactaaaaatacaaacattagccaggcgtggtggcaggcgcctgtaatcccagctacttcggaggctgaggcaggggaatcgcttgaacctgggaagcggaagttgcagtgaactgagatcgtgccactgtactgcaacctgggtgacagagcaagactccatctcaaaaaaacaaaacaaacaaacaaacaaaaaaagagttctagacagaattcataaattgaaaggttctggaaaagaaaaactttccttggcattcatttgttattgttcagtgattttcaatgaattaaatctatttttttttttgagatggagtcttgctctgtcgcccaggctggagtgcagtggtgcgatctcggctcactacaagctctgcctcactacaagctctgcctcccgggttcaggccattctcctgccttggcctcccaagtagctgggactacaggcgcccgccaccacgcccggctaattttttgtattttttagtagagatggggtttcaccgtgttagccaggatggtcttgatctcctgacctcgtgatccgcccgcctcagcctcccaaagtgctgggattacaagcgtgagccaccgcgcccggccgaattcaatcttaagaaaggttactagagaaggaagaatggtcttgatatattgtaaatacagataatgaagtcctagaaatctgacttattgtcccagcagaactaggaagaaaacccaaattctgacttctagttatcttccctggaaagcacacggttggtttgctttaaaattcaaggatttccagtaagagtgttttagcactttaaaatacagcaaagcaagtaaacctaacatgactctgacctggcaatgatgtcatagaaatgcattttgttttccctctctttgctcaaagcttgcaggagactgttgtaagtggccgaatcttgcaactccttaatggtatctgcaatcacatcgctgaaaaactgcctgtaaggagaaacagaccaacaaaaaatgagttaataaattctattttcagccgggcatggtggctcacccctgtaatcccagcactttgggaggctgaggcaggcggatcacgaggtcaggagatcaagaccatcctggccaacatggtaaaaccccatccctactaaaaatacaaaaaaattagccaggcgcggtggcaggtgtctgtaatcccagctactcggaaggctgaggcaggagaattgctggaacccgggaggtggaggttgcggtgagcagagatcaccaatgcactccagtctggcaacagagtgagactccgtctcaataaataaataaataaataaataaataaataaataaataatattttcaggccaggtgcagtggcatgtgccctaattccagctacttgggaggctgaggtggaagaattgcttgagcccaggagtttgagatcagctgggactacacagcaagacctggtctcaaaaaatatatatatgtattatatatatatgtatttatatatgtattatatataatatacattatatatgtataatatatattatatatgtataatatatgtattatatatgtattatatgcatattatgtattatatatatgtataatatatattatatattattatatattatattatattgtattatatattacatattatatatgtataatatatattaatataaaatattatatattatacatatatataaaatacatatattatacatatatatataaaatacatatattatacatatatatatataaaatacatatattatacatacgcatttccctacattcacaaagggctacagaagtcacacaagttaagacccaggccaggtgcagtggctcacgcctgtaatcccagcactttgggaggccaaggtgggtggatcacttgaggtcaacatagtgaaacctcgtctctactaaaaatacaaaaattagccaggtgtggtggtgcccacctgtaatcccagctactcgggaggctgaggcaggagaattgcttgaatccagaaggcagaggttacagtgagctgagattgtgccactgcactccagcctgggcaacacagccagactcttgtctcaaaaaaacacaaaaaacaaaaaaaccgcaaaagtttgattaggtctttaaaaaaatttttttaaatgatttaactttttcaaaattatgaagtatttcaaaaattcagaaagtataaagaataaaataatgaatatttatgtacgtaacaccaaatttaaatattttaccatggtagagacttggttttttttaaagattacatgtgtcagatatatctgaagtctctagtcccagtcccctcaatcttccccagagataaacactcttctgaatttggtgattattattctctagcatgttgtgatacttttattatgtgtttgtgtgttttatttaaataatacatgtagttttacatgttattatttttatttcatttttttttgagatggagactcgctctgttacccaggctggagtgtggtggtgtgatcttggctcactgcaacctctgcctcctgggttcaagcgactctcccgccttagcctcctgagtggctgggagtacaggcatgggccacctcacccagctaaaaaaaaaaaaaaaaaaagaagttttctttaatttctagtttgctaagaggtttttagtgttgatttttatatgttgaattttgccaaatgccttttctgcatctattgatctttctatttatttatttttttacattttctaatgctaaactatttttgcattcctgggataattccaattttcattatgatgttcattctgggtctttttttttttttttttgagacaagagtgtcgttcttgttgcccaggctggagtgcagtggcacgatctcggctcactgcaacctgcacctcccaggttcaagcgattctcctgtctcagcctcccgaggagctgggattacaggcacgtgccaccacacccagctaacttctgtatttttagtagagacagggtttcaccatgttgaccaggctggtgtgaaactcctgacctcaagtgatctgcccacctcggcctcccaaagtgctgggattacaggcgtgagccacggcgcccggccaaacgttcacattttcgagatgagtaaaccaggttcaggaaacattcacatttttgagatgagtaaaccaggttcaggaaagttaagtgacttgcccgtggtcacatacctagtttgagaaagagctggagacatatagcccaggtttcctaacgcgtagtccgctgttcttcatgatcctctcctaagtggagctgtttaggccgggcacaagagctcacacctgtaatcccagcattttgaggggccgaggcaggaggatcgcttgagtccaggatttcaagaccagtctgggcaacatagtgagaccccctccccccaccccatctcacaaaaattaaaaaaaaaaaaaaggctggtcatggtggcacgtgcctgtagtccctgccacttgggaggctgaggtgggagggtcgtttgaggctgtagtgagtcatgtttgtgccactgcactcctgcctgagtgacagagtgagaccctgtctcaaaataatgataataataaaataaaaattaaaaatggctatttaatgtcttgacacagttggcaagaattatagttactattttacataacaactcaagggagagggagatttagagaatagccagttttagctggtatggtaaggaagtcccctttgctttaatctttccaagaaaagtaattttgtggccgggcgcagtggctcatgcctgtaatcccagcactttgggagactgaggcgggcggatcacctgaggtcgggagttcgagatcagcctggctaacatggtgaaaccctgtctctactaaaaatacaaaattaaccaggcgtggtgacgcacgccagtaatcccagctactcgggaggctcaggcaagagaatcgcttgaacccaggaggcggaggttgcgtgagccgggattgcgccactgcactccagtatgggcgacagaacgagactctgtctccaaaaaaaaaaaaagaaaagaaaagtaaatttgtgatttttaaaattgttaattaattaattagagacagggtctcgccctgtcactcaggctggaatgcagtggcatgatcgtaactcactgtaacctcaacctccccggcttgagtggtcctcccccgcctcagcctcctcagtagctaggactaaagcacgccaccacgcccagctaatttttttcatttttgtggagatgaggtctcgctatgttgcccaggctggtcttgaactcctagcttcaagcactcctcccacttcagcctcccaaagtgctgggatcacaggtgtgagccaccgcctgcagccaggaaagtaacttcaacatgaccattcacgttatagtctctgtttctgctttcttcagccctttctgcctgtaaagccaacctcctctgcccaggtcatcagaacagtacttctacttcatagaatgaggtgttgcctgatttagaattgcaaataaaagccaattaagatgtttagatttgtggcctggcgcggtggctcacgtctgtaatcccagcactttgggaggctgagacgggcggatcacctgaggtcaggagttcaagacctgctcgggaggctgaagcaggagaatcacttgaactcaggaggcggaggttgcagtgagccaggattgtaccattgtactccagcctgggcgacagagtaagactctgtctcaaaaaaagaaaaaaaaagatatttagatttgttgtaattttgtcttttgacagtagtatgttatgataaaataattattaattcaatgcaataagacaataatgcataaagatgagtacagcaaggaaagcatacacaagcttcctacaaattcccattttaaattcataaagagttgtagtttttttgttgttgctgttttgctttttaagtttttttttgagatggggcctcactgtcacacacgctggagtgcagtggcacaatcacggctcactgcagcctcaatttcctaggctcgggtgatcctcccacctcagcctccagagtagctgggaccacaggcccaccaccatgcccagctacttttcttgatttttagtagagatgagatttcactatgttacccagctggtttcaaactcttgggctcaagcaatcctcccaccttggcctcccaaagcattaggatcacaggtgtgagctgccacgcctggcctgttgtagtttttatgtccttgatattttgatttccacttgattctggataactggtggagatgtacattttgtgaatataccctgggtttcagatggaatataaatctaaaactaatcccctacaaataattgcgactggtattttgggtctttcaggaaaagatacgagccacacactgagaatgaaaaggacatgaagcgggcaatttataagcaggttgcctttctgtccgatgcagatctgggccaggctgactttagcaagatcttactcttggttagggtcgaataccgaggtcagcaaactctttctgtaaagaggcacgtagtaaatattcggctttgcagggcgtaagttctctttggcaacgactcaactctgcattgtggcatgaaagcagtcacaggcaacgtataaacaaatgggcgatgccgtattccaataaagcttttcaaaaacagacttcagactggatttagctagtggtcctgcgtaattgcagtaaaaactctcatttaccaaaagttcttaacgtaatgttacaccctcttaacaggcttatttgtcatcgagccagctgacaacaaaacattatgagacaatgggaatttagactgcctttaagaaaccctcaggattaaaacacagtttggaatttggctatgtagaataataatagctatatagtagctattaatggataaagcatcacaatagctaccaagctgtgccaggtactaaagccttatttctaacccttacactaaggttgcaaggttgctatcacggtctttttcttttctcttttttttttttcaagacagagtcttgctctgtcacccaggctggagtgcagtggtgccatctcagctcactgtaacctctgcctcccaggttcaagcaattctcctgcctcagcctcctgagtagctggtgccgaggcacctgagattacaggtgtccaccaccacgcctggctaatttttgtatttttagtagagacagggtttcactttattggccaggctggtcttgaactcctgacctcgtgatccaccagcctctacctcccaaagtgccgggattacaggttgagcccccgcgcccagcccattctcatttttaataattgaaaacagccagtgtggctgtagtcccagctatgtgagaggctcactggaagccagaagcttgagggcggcagtgctctatgatctctccagtcaatagcactggcttccagcctgggctacagagtgacctcgtctctaaaaaataaacaatctgcaggtatacagctgaaggaaaaaaagaaaaagaaaaaaatttaaaaaataaataaaataaaaattggaaacaaagacaaagggccgggcgcggtggctcacgcctgtaatcccagcactttgggaggccgaggcgggtggatcacctgaggtcaggagttcaagactagcctggccaacatggtgaaacccgttgtctactaaaaaatacaaaaattagccgggcatggtggcgtgcacctgtaatcccagctcttcaggaggctgaggcaggagaattgcttgaacccgggaggcggaggctgcactgcgccgagatcagaccattgcactccagccttggtgacaagagcgaaactccatctcaaaaaaaaaaaaaaaagacttaataacttatgcaatatcatatagctgccttgctttccattcatatcaccctgcctctaggcagtctttagctaattctattctcagcagtcattttgcatacacagtaatgactaacctgtagacgatagcagtcagccacctgggcgccccttcgctcatctatgtgtaaatacgttatttcactgccaaatgtcttccttccttacctatcaatctgaattttcttcagtgtctccgtagtcatgatggtctgccttgtaggttttttgaagacaagatcctgcattttgttaaactccacagcgaaccggcctctgtgtctgatttctggcaagttgggtccttcctcagttattaacggactgggtatttttgtgattgttgaggccattggaagtttgtctagattcgttccttctagattcatttctctgcttttcttttaaaacaataaacaattagaaagaatttttttaaagagacaatacaacaagaaagaggcctttgtgtacatttttcaacattatcttctctgacttctactctatactccaagaaaatgtgcccctttcttcagccacaccaaaccacacgcgccctgctgctaacttcacacaacattcttcttctccgtcattccccaacttaccacctggtacactctgctcaaaagtaaagttctttgtgaaatatctctgttagcaggcatttctcatgttgtaattttttataaagtatctccatcaggtcgtggtttctagggtcggggggacagtgtcttagagatcttggttccacttcaagaaaaactttttttgaagactagtctcaagttatttttggaacaagattggatattcaataaatgtggccatctttgtagtcccattgcttagaacaatgactagcatatagcagagacgcaaatgttccttgaacatatgaacttgaaatacaaataaaaaaaggagaatcatactaaaagcagaggttgatagtacatttagtggtgtggtgtagactttgaggatcatggagggaaaagccaaaataatttttttcagaaccaaacttgaatattaagggaccgcaggaacggcgtatgcctttcagctgatggtgctgactattaagggaccgcaggaacggcctatgcctttcagctgatggtgtaaactaaactgtggctaaaagcttgagccactgaggcacacgatgcagcgactacacatacggattctgaagccatgtttgaatcctgctgtctctcaactctattgaccttgggcaactagttaacatctctgtgtccccattttcccactggtaaaataaatggttattattttagattttgcctaaggcaataaggggaaatgtaaggtctaggaggctccactgtcttttttttttttgagacagggtcttgctccgccgcccaggctggagtgcagtggcgcgatctcggctcactgtgacctctgggatgccccattttctgagttccctaaccactattcctctacctttatacttggacatctggaaaaggaaccaaatgtgtctcatggcctgatttactgattactagaaagaaatgtgaatttttagaatagaattaaagaaacgagctaagtgttctagttgacgcactaaaaaaaattttttttgagacagagtctcactgtgtcgctcaggctggattatagtggcaccatctccactcactgcaacctctgcctcccgggttcaagcgattctcctgcctcagccttccaagtagctgggattacaggcccacaccatcatgcccggctaatttttttgtatttttagtagagatgaggtttcgccattttggccaggctggtctcaaactcctgacctcaggtgatccacctgcctcggcctcccaaagtgctgggatgacaggcgtgagccaccgtgcctggcctctaaaaatttacatatatatatatatataataatatattttatattgcacatgctatgtacaagatagggttttttaccgtaaggaaaaagagaagaaaaacagtattccctgcaagaaaactctttccaaactttggtcaaatcactctcatttctggcagaaccacgtatattaatatatttttcatcctttcatttcataattctaatacatgaaaatgtatctggagatggccttagccataaaaacggctttaaaagagggaaaatgctaatctttcctctcaacgttgttaaaaggctcaaggatgtcaagcctttgggaaaggaaacatccatatactaacatttaaaaatatacagcctaggccctacagggcagcggcatcttcaaattcatgagtcagaacaactatagtaccatgaaatacaaaccaaaaaatattttaagagattcacaatttttaaaagatatgaagctaacatattgagaaatgggcttttaaattgctattaatcaacatgattaaagttactataattatacatattatatattactatttacactacagtaaaatcacaaggagggtttctgttgagtcagaaaattttgtgggtaaaagatcactatgataaaccagaaaaaaacagtgcaaaagtttcattcatttactggagtagtgaccactgctgaacactgtcgattaatttagaacactgtcattcttgatattccatgatggcaaattactcttttcaaaggctgacagcaggtagcattgaaaagacttcatttattaactgaatgccttcccatttgtttgtccttccttccttccttccttccctccctccctccttcctctctctcctctctctctcccctctctcctctgtctctttctttcccttccttcctccctcccttcccttccctctccctgccctcccttccccctccctcccttcctaccttcctctcttcctttctttcttttcctccctccttccctttcttccttccttcctctctctctcccctctgtctctttctttcccttccttccttcctccctctctcccctcccttccccctccctcctctcccatccccctccctcctctcccatccccctccctcctctcccatccccctccctcctcacccttccccctcccccttcccctccctccctcccttcctcccttccttccttcctttctctctttctctttctttctttccctccctccctcccttccttctttctttctctttcaacaaggtctcactctgtcacccaggttggcatgcagtggtgtgaccttggcttgctgcagcctcagtctcatgggctcaaatgatcctcccatatcagcctcctgagtagctgggactacaggcgtacgccacaattcctggctaatttttgtattttcttggtagagacagggtcttctatgctgcccaggctggtctcaaacttctggcctcaagtatttctcccaccttggcctcccaaagcacccattttattttttattcttgctgaaggagataataaataggaagaatacaccagtctcttctgtactatttgttagccagcttaaattgttaagattagcctcttattttaaatgcagtggaagattttgttcttagatccttatctgtttgcccttcataagttaacaaggaagttaacttacattatacaattcctgtgatacttacagcattttaaaactaccccaaaactcgcagaatgccagctctggaagggatctatgggtcatttaggtaaaactccattacaacttacaaatgagaaaacttagaccaaaaaagtgaaatgattgctaacagcacgtaactatatcccaaacgtctcctgactccaaatccattgttttgtaaaatcttatctaaactttttaaactttaatgaaagctttaagaacccgggctgctcgggaggctgaggcaggagaatggcatgaacccgggaggcggagcttgcagtgagccaagatcgcgccactgcactccagcctgggcaacagagcgagactccgtctcacaaaaaaaaaaaaaaaaaaaaaaaaaaaaaagagcccaggctgtatatataacaataataatttagaaaatttgaaattttaatggaaaattaaagggaaatttaattttcttctcttgataaatatggactttactgttagaaatgaaaagcaaaaacaaaacaaacaaaatgaaaaaaaaagcaatttaccctcttatttatatagcaattttcaatggtcatagaatcagacataagaatatcttctgggctgggtgtggtggctcacgcctgtaatcccagcactttgggaggccgaggtgggcagatcacctgaggtcgggagttcaagaccagcctgaccaacatggagaaactccgtctctactaaaagtacaaaattagctgggcgtggtggcgtaatcccagcacttgggagactgaggcaggagaactgcttgaacccgggaggcggaggttgcggtgagcctagacactcctgggcaacaagagcgaaactccatctcaaaaaaaaaaaaaaaaaagtatcttctgaacaagttatataatgttattatttataacttgataaatgtgtacttctatttataaattgtttccattttatacctacaacctaagttactgaaatgtacaagagcttaaaaatgcataaagactttgctcactactaagttaattttctgataactcagtgctgcttcacagaggattcatcaatgacaacaaagtcattttagattaaagcgttaagagtggagttgaatttcctccccctagtgttcagttaggttgcagcagctgagaaatacaagttgggtgggacaactcagtaattccatctcttcagtatatagattgtattcatactgatttcagtagaggcctttttgggtaaaaccaatatactagaaaaggatattctgtctggtaatataccttgagttatggcaatttcactccatcagttgagagtgcatatctcagatagttattgtagcccctttatctgaaataaaggtgctatttcccacgtgatatttaatggcaccagcctggacaacatagtgagatcccatctctatagaatttttataaaaaattagctgggtgtggtagtgcaggcctgtagtcccagctacccaggaggctgaggtgggaggatcacttgagcctgggaggtagaggctgcagtcagccatgatggcaccactacactccagcttaggccacagagcgagaccctgtcaaaaaaaaaaagaaaagaaacaaagaaggaaagagagagagagaaagaaagaaaaataagtacatttaatgggataggtactataaatgagggagaaataaaaaataaagcaaaattaactcatggtgagtgggtctataccacgcagatgctctgtctcccttcgtactgaacgggcatgatgtagttcagaatagagagctggtctgtggtgtcctccagaactgccgagatcctcagcacatctggaagggacagtggctctagagtttccgggatttctgggatgatttctatgtctgtttctttaggtattccttcttcttctacggtactaggtggttcgcctgtcactgacaccgtcatctcagaatgccaaacttttggaggaaggtttgagtcttccaggctgtctctaaggaaagaataaagaaaaaataagtcagcaaccaatatttaaacattactttaactcaaaagcacaggcagcaacgtgctgggctcctgtgatattcacatcgtcgtataatagaacctagatgaaaaaaaaggaggatttggcgtgtgattctgctaagtatcttccattttgaccaaccaaaggcaaacaacttactctttttttttttttctttttttcagatggagtttcgctcttgttgcccaggctggagtgcaatggtgctatctcagctcaccgcaacctctgcctcccaggttcaagcgattctcctgcctcaccctcccgagtagctgggattacaggcatgtgctaccacacctggctaagtttgtgtttttattttattttattttattttattttttttgagacagagtctcactatgttgcccaggctggagtgcagtagcgcgatcttggctcactgcaagctctgcctcctgggttcacaccattctcctgcctcagcctcccaagtagctgggactacaggcgtccaccaacacacctggctaattttttgtatttttagtagagacgtggtttcaccgtgttagccaggatggtctcgatctcctgacctcgtgatccgcccacctcggcctcccaaagtgctgggattacaggtgtgagccaccgcgcccggccagtttgtgtttttagtagagattgggtttctccatgttggtcagactggccttgaactcctgacctcaggtgatctgcccaactcagcctcccaaagtgctgggattacaggcgtgagccaccgcgcctggcctactgtttaataaaggtatgtagttcatgcaatttggctattctgatcaatttgaatttgagccaaaattaacttttttttccctaggagtatctttggatgctaaccaaaagtgtctcatgatgagtgaaaaacagaatgtggtatccagcctccaaggtggcccaaatgattctcactttctagtgttaacgcctctgtgtagtctacaccacaccgagcaggactagcctatgtaaccagaaggttacggtggggatgacggagtgtgacttgcaaggctaggtgataaaagacattgcagcttctgcctcactctctcaaatctctcactgtgagggaagacagctgccttggtatgaggacacttcagcagcactgtggacacatccatgaaggtaaggaactaaggcctcttgccggcagcctgcaccaacttgccagctctgtcaatgaaccaccttggaagtggatactgcagcccccatcaagtgttcagatcattgccacccctggccaacttcaagttcaggagagacctcaagccagcaccatccagctaacctgctcctaaccttgggacccacagaaactgtgggaaagaataaatgtttatattttaagtcactaagttctggggtaatctgttacgcagcaatagataaggtatacacagaaatttaacagaaggcataatttaaatacatgtatacaaaaaacattggaattttaaacatactcttccattcttctgtagcttcgttaccctccgtggtatatttataatctcacaaaagtgcagttacctaaaatgggaaagaaacactgagattagtttatgggcgtcttgaatgatgtttcagttatttctataccatttcattaagagaaaattaaatgattacgggagctgtgactatcgcctctttgtgcggagtggagcagtcccagaggcgaaagagcctccgacatcatggagtgcaggtctatgaagaagtcaactgagttattactgctctaccaaactcaagacacatgcactctgtgagcctcttctttaggtaaattaatgttcaacgtggttttagtatgttctattatatcaccgatttttaattggtaatctctatatacttgattttttctatcattctgattactgtaatatttaattaggtcactcaattcatcttctctgccagataacagaatttgctccacatggacttagaggaataagtgagatgacacttagaaaaactgtattaattggggccgggcgcgggggctcacgcctgtaatcccagcactctgggaggccgaggcaggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacctgggaggcagagcttgcagtgagccgagatcgcgccactgcactccagcctgggcgacagagcgagactccgtctcaaaaaaaaaaaaaaaaaaaaaggaaaactgtattaatcctggaaatcagtttaacattgctatcaagatgttacccctcctcagtaaaccaaaatcctttctgcttaaatgagctttacagtgaaaacccctatggagaagtttgcgttgtactgaatggacagtgagtggtgagtttccaatgtaaatttgtccacaataaagcaactctgagagacgtggtgcaaatatgactcttgcaacaaaaatcttacatgcaaaaattcaaacacacaaaacagaatcttcacataaatttgaaaaagtacttcagactagccaaatgtcctgatgcaggggcagttttaggaggaagtagcatggtattaagcagaatacctttctttttttcttttctttttttttgagatggagtttttctcttcttgcctaggctgcagtacgatggcgcgatcttggctcactgcaacctctgcctcccaggttcaagtgatttccctgcctcagcctcccgagtaactgggattacaggctcacaccaccattttgtatttttagtagagacggggtttcaccatgttggccaggctggtctcgaactcttgacctcaggtgatccacctgcctcagtctcccaaagtgttgagattacaggcgtgagccaaggcgcccaggcggattttactttctatttccatatctcctaagctggacctagttgttgctgtgtttgtttgtttccttgttttcttttttgcttgaactactccaacaacctctaaattggaagtgatcttttaatttttaaattttttttttctgatatcctgacagaaggttcaggaagtgagctttttaaaatgaaagggtgatcttttaaaatggaaaatctcatcatgtccttccctagaacccttcaatggtttcccgttgccttaggacaaagaagaaaattcttgacttggtccacaaggtctgtatgatctgggcccctctgttcctctctagacccaactacaactgcactttccttgctctctgggctccagccacagtgggcttctttcagttcttctctggactcatgctcccttgcaactcagggtctttgcacctgctattccttccagtggagccactcttccctcaccttttcaccgtgtaaagtcccactgacccatcaccagcttaagacagtgtcatttttctaggtgaaatctctaacattttctgtgctctgagagatggacccgtatggagtatatccaggggagattccagaaagagattcagtgtagagaagtgagatcagacatttattctccctgctccttctctgccagaatataattggttggttatgttcctctatcaaaggtcatggctcctgtcaggcaattctctccaaacgtctctctctgggcttaggtaactatttctttcctaggtcccgggagactccatcatcccttgtagtttcactcctgctttaccttttttttttttttttttttttttgagacggtctcactctgtcaccaaggctggagtgcagtggcaggatctcagctcactgaaacctccccctaccaggttgaagcgattcttgtacctcagcctcccaagtagctgggatgacaggcacacaccaacacccctggctgatttttgtatttttagtagagacagggtttcactatgttggccaggctggtctcaaactcctgacctcaagtgatccacccacctcagcctcccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttgtctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagacgccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatcagtagtactcggggtattcagggatagaggcatgtaggtatactggctgcgtaacataaaaccgtaaagtgtagaggaagaaatagggcggcatctcaaagaggaaatggcaggaagattttaggaacacaagtggctgactggaaagtccagaaaactaaaatgccacatgagaggtctcctgtactgaactgaggatcttaggcttaagattgttcttgagtgtaatacaacgtcactgaagaacttgattcacaggaaattttaaaatttactcatttgagacagggtttctgttgcccagcctgtagtgcagtggtgtgatcatagctcactgcacctttgaacttctaggctcagacaatcccctgcccacaacctccagagaatctggtgcatgccaggcacgtccagccaattaaaatgttttttcggggtcccaggctggtctcgattcctggcctcaagtgatccccctgccttgttctcctaaagtactgggattacagatatgagccaccagctcagattatttcaaatcccaatggcatcccagcataaacaagggaaaattaggtgggcttttcagtctcaaatggagaattctaacatgtttctggctttgggggctggatggataatggtgcatttacaaagttggggaatcaggagatggttttgtgggaggagctaaagttgaatttgaggaagctgtaagatgttaacctgtggacatatccatgaagacagatgggtatttcaggtctgggttaggcatatggagaagtggatggtattctgagtggaacagacacacggtaagtggtaggcatctgagcaaagcgggggaaaacaaacggttgagactttaactcgagtaacttacatgtgcaatggcaaatgagactcaaaagcaaatacatgctcttccttactgagatgatgcagcatttgtaaataataaatgtatgtttttatgtttttctcctcccatatggaaattaagtcaaaagtactcaagtcaccgttgccaaaggaggagtcctgtggtttacaggaaagggcttgcgtggctggtaacttgtccactacaccattgaaacagctttgcctcctggctgggcgcggtggctcacgcctgtaatcccaacactttgggaggcggaggcgggcggatcacctgaggtcatgaggttgagaccagcctggccaacgtggtgaaactacgtctctactaaaaacataaaaattggccgggcgtggtggcgggtgcctgtaatcccggctactcgggaggctgaggcaggggaatagcttgatcccgggaggcagaggttgcattgagccgagattgtgtcactgcactccagcctgggcgacgagtgaaactccgtctcaaaaaaaaaagaaacagcctttcctcagcataacactattgttacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtagggcgacatgggcgggagcgggccctctcagggtaaagtcacccagaaggagcaggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaaaaccctgcacttctctcttttaatttggattaaaataagagaaagagtcctggtccctaatacgtttcgctagttcctcatagagtatataaataccctgtcgtcctcactattctccttgttttaacctggacacggagtatagccaggagctacagtgttcactgtagttacgctaatgactatacctctgttcaatgctacaggaaattacataacttttttggttttggtggtgttggggagctacaaaacagttttactttttaactggttctcaactaaagcctgtaagttttgtttttaccttttattacgccggtacaaacaacatcagaataatttaatgaacccgcatggacccatcacctagctttaacacctagctttaaggttccgccattcttgtttcatatactttcagccattccgcagccccctacttgagttactgttcttttgaagttttttggtaaaatttacatatattgaaatgccacaaatgtatccatgcacatccacataaagcatacaacccatcacaacatagaacgttcccacatctccagacgttccctcctgtcctgtgccagtctcctgcccaccccaggcaactagttttctaattgttttttttttaaatactagattagtttggccaattctagagcttcgtgtattgaatggaattatatggtatgtactcctctgtatttggcatctgctcagcattatgtctgtgagattcgtgttgtatgtgatagtaatttattcctttgaattgctgagtattccattgaatacttatatcacaatttgtttttccgttatcttgttcaaagatgggtattttggtttcttccagattttagctattataaataaagctgctgtcaatattcttgtacagtaatttttgtggatatatgttttcattgttcttggataaatacctaggggtgaaattactgggtcaagggtaggtgaatgtttataaaaaatactaaccctttctccaaaatactctaccattttacacccccatcaacaaaatattagttatggttgctgcatatcctcaccaacagatgtcctttctaagaaatctttaaataccccctaggtcataaaaatattctcctgtgttctagaagccttcacttttaggattatgattcatctgaaattaatttttatatatgatgtgagataggggatcaatatcctttttttttttttttgccccatatgggtattcagttgcctggattatgtacctctgtaataaatattgaaatcagacagtattgttattgtaagcattcctgctttgttcttccttttcaaaatgattttggctattttaaggcttttatatttccatataaatttatttattttttggcagggggaggctcaaagacagatccatataaattttagagtcagcttctcagtttcttcaaaaaagcctgatgggtttatgattgggattgcatttactctatagatgatttggagataattgacatctaacagtatcaagtctttcaatccatgaacataatgtatgtttctccatttattgaggtgatgcataatttttctcagcaaaaatgtatagatcttgcattttttcttctgttttcttttctctctcttttttttttttgttttgttttgagacagtcttgctctgtcactcaggctggagtgcagtggcagaatcatagctcacagcaggcttgaactcctgggctcaaatgatccttctgccttaatctcccaagtagctgggactcccaagtatgcgccactacacttggctaattttttattttttgttgagacagagtccaggtgggttttgaactcctggccttaggcgatcctcctgcctcgacctcccaaagtgccaggattacaggcatgagccgccgtgcccagccagatcttgcatgttttttgttaaatgttttcctaagtcttttattttttgatgccattgtcagtggaattatggttaaagttttccagttgtttgctgctagtatgtaaaaatacactgctagtaggtagaaataatttttgtatattaaccttgtcttctgagacctagctaaacttatttattctactagggtttcctcccttacaatttttgatgttagcaatgtattaactataaataggaacaatttttgttgttgtagttttgtatcatttatgtattttttcccccttattgctctggtgaggacaggcagttccaggctgagcaaaagtgagatagcacgcctccttgccatttgttcctgatcttaggaccagtctctgaccattaagtatgatgttaactttacatttttttgtagttccctttatcagattgagaaagctccctttggtttctggtttcccgagggtttttatcctgaatggggacaaattttgtcaaatgctttttgttttttctggtaattattgagataatcatatagtttctcactttatgaactgttatgtggtagattacattgcattttccaatagtaaatcaacgttgcttttttgggataaaccttacttggtcatgttggctttggtaattttctttaatgtttgtttctatttcattgttttctgttctttgttatttcctttttctacttattgtggatttagtttgctcatattgttaggcggaaacttagatgactgttttttaacctttttttccttctaatgtaaacattcaaagatataaatttctaagtacaactttagctgctcttcacaaattttgacactttgcattttaattatcatttaggttaaaattttttttttgttttttgttttttgttttttttttttgagacagagtcttgctctgttgcccaggctggagtgcagtggcgcaatctcagcagagcaacctcggcttcctgggttcaagctattaccctgcctcagcctcctgagtagttgggactacaggtgcacgccaccacacccagctaatttttgtatttttagtggagatggggtttcaccatgttggccaggatggttttgatctcttgaccttgtaatctgcctgccctggcctcccaaagtgctgggattacaggcgtgagccaccacgcccggcctaaaaaagttttttaagagacagggtcttggtcgggtgcagtggctcatgcctgtaatcccagcactttgggaggccgaggtgggtggatcaccttaggtcaggagtttgagaccaccctggccaacatggcgagacctgtctctactaaaaatacaaaaattaaccaggtatggtggcgggcacttttaatcccagctactctggaggctgaggcaggagaattgcttgaattcaggaggtggagtttgtagtgagctgagattgtgccactgcattccagcctgggcgacaagagcgaaactctgtctcaaaaaaaaaaaaaaaaagaaagaaagagacaaggtgtccctctgtcacccaggctggagtgcagtgatatgatcatagctcactgccacctcgaactcctgtgttcaagcagtctccccgcctcaaccttatgaggagctaggacttcagccacatgccaccacacctggcacattttttatttttatttttgtagagacagagtcttgctgtgttgcccagattggtcttgaactcccagtttcaagcaatcctcctgcttcagcctcccaaagtgctgggattacaagcgtgagccactgcacctggctgagattattttatttatggtttagaatatgatctatcctgtttaatttttcacgtgtacttgtgaagaatatatattctatagtttttttttattttattgttttagagatgggatctcagtatgttgcccgggctggtcttgagctcctggactcaagcaatcctcctgccttggcctcccaaagtgctgggattatagacatgagtcactgtacctggcctattctgtagttattgaatatagatttctatacatgttaataagctgaggtgattgatactttacttcagattttctctattaaaaactattggccaagtacagtcactcatgcctataagtctagctcttttggaggccgggatggcaaatcgcttgagctcaggagttcaagaccagcctgggcaacttagtgaaaccccgtgtctacaaaaaatacaaaaattagttgggtgtggtgttgtacacctgtagtcccacctacttggtggggctgaggtgggggaatcacttgagcccaggaggtgaaggctgcagtgagccaggttggcaccactgtgttctagcctaataaagactgtattaatacaggagaaaataggtgtatttagcttgcttgtggttcaagcttacatgtgtatcttttcagttgcctacatttacctgtgtgtatgtgtgtgtgcttgtgcattttaggcattacaacatatatcttttgtttattgcatgtttttatttttgagacagagtctctctccgttgcccaggctggagtgcagtgacacaatcttggctcactgcaacctctgcctcctgggttcaagcaattctcctgcctcagcctccagagtagctgggattacaggcacctgccatcatgcccggctaatttttgtatttttagtagagacaagtttcgccatgttagccaggctagtctcaaactcctgacctcaagtgatccacccgcctcagcctcccaaagtgttgggattacaggcatgagccactgcacctggcctattacatctttaatgttaatattatcacactgtctggggcatgatgttgaataagagtggtgagagtagacatccttgtcttgtttctgatcttagagggaaaacattgtcttccactgttaaaaatattaattgtggagtttttgggtaggtatgctttataaaattaagaaaattcccttctatacctagttttctaagagttttttttttttttaatcatggatggatgttgaattttgttaactgtctttcctgcaccagttgatacaatcatgtggcttttcttctttactctgttgatattatgagttacattgattgattttttttgaatgtcaaatcagccttgcattcttgagatgaacctcacttggtgatgatttattaccctttttacattttgctgggtttgagttgctcatattttgttgatgattttacatctatgtatttttatttttttagagacagggtgttactctgtcatccaggctggagtatagtggcacaatcatagctcactatacagccttaaatgacttggcttaagcagtcctcctgcctcagcctcccagttagctaggattacaggtgagagccaccacacctggttcatttattttcatgtttagtggatatgggctcttgctgtgtttcccagtctcgtctggagccactgggcccaaggagtcttcctaccttggcctcccaaagctctgggattgtaagtgtgagccactgcacatttacatctatattaataagggatattggtctgtagtttttttaattttattttttaaattttatatttatggttttttaccaactacctgcaaggatactggtctgtagttttcttttcctctctaataataacttcaggtttatcgggggaacccgcccccaatatttcaaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttttattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgataagggtctgtgttcagcagtgcacgtattgtcttgataaacatcttaaacaacagaaaacagggtttgagagcagagaaccggtctgacctcaaattcaccagggtggggttttttccccaccctaataaccctgagggtactgcaggagaccagggcatatttcagtccttatctcaaccacataagacagacacttccagagtggccatttatagacctcccccaaggaatgcattcctttcccagggtcttaaatattcattgctgggaaaagaatttagcgatatcttccctacttgcacatccatttatagactctctgcaacaagaaaaatatggctgtattctgcccaactccttaggcagtcacaccttatggttgtcttcccttgttccctaaaattgctgttattctgttctttttcaaggtgcactgatttcatattgttcaaacacacatgttttacaatcaatttatacagttagatacaattatcacagtggtcctgaggtgatgtacatcctcagcttaggaagataacaagattaagagattaaagtaagacaggcgtaagaagttataagagtacactgggcgtggtggcttatgcctgtaatcccagcaatttgggaggccgaggcgggcggatcacgaggtcaggagatcgaaaccatcctggctaacacggtgaaaccccgtctgtactaaaaataaaaaaaaaaaattagctgggtgtggtggcaggcacctgtagtcccagctacttgggaggctgaggcaggagaatggtgtgagcttgcagtgagctgagattgcaccactgtactccagcctgggtaacagagcaagactctgtctcaaaaaaaaaaagaaaagaaattgtaagagtattatttgggaactgataaatgtccatgaaatcttcacaatttatgttcagagattgcagtaaagacaggcatacgaaattataaaagtattaattttgggaactgtatgtgtccatattaaaatgaaatcttcacaatttatgttcctctgccgcgcctccagccggtccctccgttcagggtccctgacttcctgcaacacaggtttggtatcaggataatgctggtctcatagcatgagttgggacatgtcccattttcttctatattcaggaagagtctctgtagaatcaatgttgtttcttccttaaatgtttagtagaattcactaattaagccatctcagtctggaattttcttttttgaaagtcataaactatgaactcataaactttgatattggactattcaggttatttatttcttaacagtgttttattaagttatgtctctcaaagaatttcacttcatttaagttgtcaaatttatggacatgaagtttttcataacattcctttatgatcatctctaaattgctggaaagtctgtagtgatatcttctgtgtagtttctgacattggtagtttgtattctctctgtcttttttttttttgagatagggtctcactctgttgcctagtttgaagtgcaatagcacgatcactgctcactgcagccttgaactcctgagctcaagcaatcctcccaccttagcctcccaaagtgctgggattataggtatgagccaccatgccagccttagtgctttctttgagtttaatatatatatattttttttagtatcttaaggtggaaccttagatcatgaatttgagatcttttttctaaaataggcatttaaagctatcagtttcctctaaatactcctttagctgtatcccacaaatattaacttgtaattttattttcatttacttctattttctaatttcccttgtaattttctctactaactaagggttatttagaagtttgttgtttgattttttcaaaagtatttggggattttcccagatattgttctgaaattgcattctagtcgaattttgttattgatagagagcatcctttttaccagttcttttatgtcttaaagtttgttttatggcccaaaatatgatctagctaggtgaatgtcccacacgcactgaagcagaatgtacaacacaaaatattgagtgtttgctccagtgactacaatatatgtagtgtacttatggtatctatttaaaatagtcatgttaaatatgggacattttcaacagcataatttcattcattttgctgttgttgtaatataatattgtaaatatattaatatatgacttctttatatattttaaacctcacaattaggccagcacagtggctcatgcttgtaatcccagcactttgggaggccgaggctggcggatcacctgaggtcaggaattcaagaccagcctggccaacgtggtgaaaccctgtctctactaaaattacaaaagtacaaaaattagctgggcatggtggcaggtgtctgtaatccctgctactcaggaggctgaggcaggagaattgcttgaacccaggaggcggaggttgcagtgagccaagattgtaccactgcactccagcctgggcaatagagagagactgtctcaaaaaaacccaaaataaataaataaaataaataaaaaaaataaacttcacaattaaaaattttacaatttttgctttaaatatttatttgtctccaaagaaattaacagaagaaaagaagtgtgtataattgtgttgaggattcccaagaccactccaggtttggtgattgctaggtggcctcgctagattcagcttgtcgtcatactcacagctgagatttattacagtgaaggcatacaaagtaaaatcagcaaagggaaaaggatcatgggacaaagactagaggaaattaggcaaaaacttccaagagtcctctcctagtagagtcacttaggacctgcttaattccttcagcagtgagttgtgacagcgtgcacaaagtgtggtctaccagggaagattacctgattcttagagtccagggtttttattggaggctggtcacgtagacaaaatttcagccactgaaatttcagactccagaagcaagcaaatgttcaacataaaccatattgtttctgcaaatagtttagacacaatgagccatccttataacctagtgaagttttaaattacacttctagatgccagcaaaaggtcaaccttgcaagcaggacttcctacagagagcagcaatctctgacctgctgtgttgactcttctgcacaatagtctttcatatctattcacgtatttaccatttccaatagcttttatttcttcctacagaaacaggttacccttttgtgttatttccattcccacgaataacttcttttagcatttcctgtagtgtaggtctgctggtgatcagttttctcagatgtatgtgaaatgtctttatttcctcttcatttttgaagggtactttcattggatatagacttctgtgttgaatttctttattttagccctttcctgtttatttcattgtcttctgttctttattgttcttcacagaaagtcaatgccattcgtacttctcttcccttcctatgtataatgttgtattagttctcacactgctataaagatactacctgagactgggtaatttataaaggaaagtggtttacagttccacatggctggggaggcctcaggaaacttacaatcatggtggaagatgaaggagaagcaaggaccttctttacatggtggcaggagagagaagtacaagcaggggaaatgccagaggcttgcttataaaaccatcagatcttgtgagaactcactatcatgagaacagcatggggaaacacccccatgatccagtcacctccttcccttgacatgtgggattacaatttaagatgcaatttggctggggatgcagagccaaaccatataaaatgtgttgtttttctctcattgctttcaatattttatctttatttttagatgtcacaagtttgcctatgatgtacctggttgttgtttgtttgtttttggggacaaagtctcactctgttgcccaggctggagtgcagtggcacgatcttggctcactgaaacctccgcctcccgggttcaagtgattctcatgcctcagcttcctgaggagctgggattacaggcatgaaccaccacgcccagccttgtttgttttttatcctgcttgaggtttagtgaacttcttggatctgtaagttgatgtctttcaccaaatttgaaattttttagctgttatttctttcaaatatatattctgtctcatattttctcctgtccttataggactctaattacctatctgctagactgcttggtacccattctctgagtctctgttcttttttttttttttttttttttttagtctttttcatttctcttcttcggattggataatgtctagatctatcttcaagttcactgatgcttctgccatctccaatcttcttttaattctttctagtgaatttttttttttgagactgtcttgctctgtcacccaggctgtagggtgatggtgcagtcttggctcactgcaaccaccgtctcccgagttcaagcagttctcctgcctcagcctctggagtgctgggattacaggtgtgcaccaccacgcctggctaatttttgtatttttagtggagacagggtctcaccatgttggccaggctggtctggaactcctgacctcaagtgatccacccacctcagcctcccaaagtgctgggattacaggcatgagccaccgtgtccggccccaatgaatttttcattttaattgttatacttttaagctctagaatttccatttggctcttttttctttggttcttttcatagtgtctcttctgaggttcactatctgcttactcattatgtgtatgttttcttttaagttcctgaacacatttcagctgcattaaactagttgtttaaattcaggtcctcttagggtctgtttctattccctgctttttcccccattgtggatctcattttcccattttgttctcattgctgctgattttttattaaataatggacaccatagataatatattgtaaagtctggattctgttgtatttctctgaataatttttttttttttgtagctggcgtttaacttaactgtattcaaaattccaaactcttatctcctgttgttggcaacatttattctttgctgggttttatcgcatacatatgtaatttcgttgtcagccaaggaatttagtggtcagtcaaatatttgactgggtttcatatgcagattttggggtaccttctgtggcttcttctcttgcaagatttcctctctaacttctaattttctggtgatacaagttctgaacattttgctgtagctcctcaagccagtgaggctctgacttcctgccactccaagagacacagattaggtagtgctctcaagccaaagttagacttgcaaatctcagagatacaattcctgtattccaagagtagattcttccagattctgtctttctccctccccaaaatactgtcagacagtatattttgtccggactttgtaatgtgttatctgtggggaggttagtcatgtaatggattgctaaaatgtaccatatccatttgctgtgctcagacatttctgatttttttttttttttgagacggagtcttgctctgttgcccaggctggagtgcagtgacaaaatctcggctcactgcaagctccacctcctgggttctagcaattctcctgcctcaccctcccaagtagctgggactacaggcgcctgccaccatgcccggctaatttttttgtatttttagtagagatggggtttcaccatgttagccaggatggtctcagtctcctgaccttgtgatctgcctgcctcggcctcccaaagtcccaaagtgctgggattacaggcgtgagccaccgtgtctggcctctgatggttttttaagggccataaaataatctgttacctggagataggttggaatggaatgagtaaaatactggaagtagggtgtcaggccatcatagcagagcaggcaatacgtattgtgaaaatctgtgactgttactatgttatattaatagatcaaacgtagttttctacaaaatatagaattctgttttcttgtatacatctgcagaaatagtataaaaataaaaatgtggttgtccattgctggaattatatgagtgagatagtatacagcttacttttagttaagctaacacaattttttcttttgtacatcaagagtttcctaaagtgttgatactgctgagacctttcttgacttcttttattcatccctgaaaaaatcatgtaaatagtaaatgagaactggagaaaaaattcaaaatggaaacctctttcataaataaatttttgtcctcttttaaagtaattgaagatacttttggtctcttcctgtcattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtggaatatgggtcacagaactttttctctgggtattacacttgaaatttagttcattaattttaagtttggattgcagtgggttaatctgtatgtcttaaacagttttcaaatccgttccttttttcaggtcataaataaagttcatcttaaggcaaatcatgtggtcaagagagatgttgatgagcatttaagaatcaagactgtctatgataaaagtgttgaagagtaagtacaccattgtattgtcatctttttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttattagaaaagtaaaggaataaaagaatggctgctccataggcagagcaggcccaaggcctgctggttgcccatttttatggttatttcttgattacatgtgctatgcctctgagagataatccttatgtttttatgtcattattttcaggttgctccctgagaaaaagaatcttgtaaaggtatgtaataaatactcataacttgaattggacacttaaaattttattgcatggaaattctacttcagtaaagaaaaatatatacatgacttttgtgactgaatgaaaggtgttggtagtgaaagtgctgatcatttcacaaaaggtgtctttgtgatgctctcatgaaaactttgttggtattgggcattaaattagtctttttttgtaatttgataatcagttttctcatttttctgcttgctttctcaagtttttggggagcaaatcatgcagagaatagggtgaaaaacaatttttgaaacacattgacaacactgttctcttggtggaaatgtttattttcctgaggattgatttacctgataaccacatcagatttttaactgtgtggagacacacacacatgcacgcatgcacacacacgcgcacgtgcacgcacacacatgcgcacatgcacgcacacatgcacacacacaaagccagttcactatgggcgacagaaattgatgactttaattaaaggtaagattttcttaacataaactatcttagtgttggaatcatctaagttagtccatcattcatagtaatctagattaatagttgagatatatcacagttttgttaaaggtgtagtatcgaaggaaattaatatttaattaaaaataaaaaatagttgagatatatgttttctggctttctatttaaatggggctagggaaggaaatttctgcctaatgctgttttcccaagctgaactagaaaatgggggaaattcttttcctcctagacttactctcttcctaccccttgccatacaaccttgactaactaatatctgtattccagaattataaagctttttttcattactatcctgtgtttgcttcttttaaatataatttatctcttccttataattctgtttctttttttttttaacttttatttagaacaagcttttcccacaagcgatttcttatttagagaagacttttcaggtccgtcgacctgcgggcactatcttacttagcaggtatgtcacatgaaacacagatcattttcttcagccgtttagtactctgcctttctcgttctatgaacatggcaaggtatgaaacttatactagaattttattatgcttgttcttagggacctaactgcaaggtatttaaaaagaataaaaaagcacctgctggataatcattctttccctgacctttcattgtgagatggtctactgaattttttctgggtgtagttgtcccctgttctccagatcacctttttccctctttcatgtggatacagtgttggctttatgaagtatttgggtgtttaaaaacccaaatcaagaggatttcctatagaacccaaattctttcttagctactttcctgactaaaatagtaacattattaatgaagtaatatagcagctaccagttggtttccatgtttttaactgctataaaatattctcttttttgtatttaaactttgatgtacaaatggactgaagacaatgtgcaacaaaccaatacctccggaaggaaaacgatcctcacaggtactgcaccggggagtgtgccgcacacacaaagtgcggccccgttattgttcctgaggaacatctccaggtatttcaccctgctcttggcagtgcttttacacctgaggagattttgaatttgtgagtgtcacagaatttttacagattcaagttcaaaggcttagtagcttccttggtctacaaaaagtaaccacagatatgctgattttattctttcattagctttcaagtgagtttaatggtattttctttcttcactcctccccacaggcctccttgcccctgtttatcttggtctgctgaatcactttagcttagaacattatcttgtcttccaaaatatcttttagcaaggcatatatctcagtttgttaaaggacagtctgacatctcttaagataaaaaatatgtatgcctcaacccaacctagaaatttattccacaaaatactaatggctacgtaatatatgtttaaaggtgttctttgcaaaactataaatatgcctatttagggtatatttatgttaagttatggtataaccacgtagtagaatactgtgcagttgttaaaaagtgaaggagatctctatgtactgacttggaaagatgtttaacctcttacatgaaaaaa

(The sequence listing continues in the following parts.)

What is claimed is:

1. A method of hybridizing a nucleic acid probe comprising:
   (a) hybridizing a nucleic acid probe with a detectable label to a polynucleic acid by nucleic acid hybridization or microarray analysis; wherein the polynucleic acid is from a sample from a human subject that has Parkinson's Disease; and
   (b) detecting a genetic variation in the polynucleic acid by nucleic acid hybridization or microarray analysis by detecting the detectable label of the nucleic acid probe, wherein the genetic variation is a copy number variation (CNV) of SEQ ID NO: 1 or the complement thereof; and wherein the CNV is the gain of SEQ ID NO:1 or the complement thereof in ATRNL1 (Attractin-Like 1) gene.

2. The method of claim 1, wherein the CNV is the gain of SEQ ID NO: 1.

3. The method of claim 1, wherein the detectable label is a fluorescent label.

4. The method of claim 1, wherein the method comprises purifying the polynucleic acid.

5. The method of claim 1, wherein the polynucleic acid is isolated.

6. The method of claim 1, wherein the polynucleic acid comprises cDNA.

7. The method of claim 1, wherein the polynucleic acid is from a sample of blood, saliva, urine, tears, skin, tissue, or hair from the human subject.

8. The method of claim 1, wherein the microarray analysis is selected from the group consisting of a Comparative Genomic Hybridization (CGH) array analysis and an SNP array analysis.

9. The method of claim 8, wherein the microarray analysis comprises Comparative Genomic Hybridization (CGH) array analysis.

10. The method of claim 1, further comprising evaluating the human subject's motor skills, autonomic function, neuropsychiatry, mood, cognition, behavior, thoughts, ability to sense, or family history of Parkinson's Disease.

11. A method of synthesizing a nucleic acid product comprising:
    (a) synthesizing a nucleic acid product from a polynucleic acid by PCR or sequencing; wherein the polynucleic acid is from a sample from a human subject that has Parkinson's Disease; and
    (b) detecting a genetic variation in the nucleic acid product by PCR or sequencing, wherein the genetic variation is a copy number variation (CNV) of SEQ ID NO: 1 or the complement thereof; and wherein the CNV is the gain of SEQ ID NO:1 or the complement thereof in ATRNL1 gene.

12. The method of claim 11, wherein the CNV is the gain of SEQ ID NO: 1.

13. The method of claim 11, wherein the method comprises purifying the polynucleic acid.

14. The method of claim 11, wherein the nucleic acid product synthesized from the polynucleic acid is cDNA.

15. The method of claim 11, wherein the whole genome or the whole exome of the human subject is analyzed.

16. The method of claim 11, wherein the polynucleic acid is from a sample of blood, saliva, urine, tears, skin, tissue, or hair from the human subject.

17. The method of claim 11, wherein the sequencing is a high-throughput sequencing method.

18. The method of claim 11, further comprising evaluating the human subject's motor skills, autonomic function, neuropsychiatry, mood, cognition, behavior, thoughts, ability to sense, or family history of Parkinson's Disease.

* * * * *